US007195870B2

(12) United States Patent
Olek et al.

(10) Patent No.: US 7,195,870 B2
(45) Date of Patent: Mar. 27, 2007

(54) DIAGNOSIS OF DISEASES ASSOCIATED WITH GENE REGULATION

(75) Inventors: Alexander Olek, Berlin (DE); Christian Piepenbrock, Berlin (DE); Kurt Berlin, Stahnsdorf (DE)

(73) Assignee: Epigenomics AG, Berlin (DE)

( * ) Notice: Subject to any disclaimer, the term of this patent is extended or adjusted under 35 U.S.C. 154(b) by 493 days.

(21) Appl. No.: 10/239,676

(22) PCT Filed: Apr. 6, 2001

(86) PCT No.: PCT/EP01/03968

§ 371 (c)(1),
(2), (4) Date: Sep. 24, 2002

(87) PCT Pub. No.: WO01/77375

PCT Pub. Date: Oct. 18, 2001

(65) Prior Publication Data

US 2003/0082609 A1   May 1, 2003

(30) Foreign Application Priority Data

| Apr. 6, 2000 | (DE) | ............... 100 19 058 |
| Apr. 7, 2000 | (DE) | ............... 100 19 173 |
| Jun. 30, 2000 | (DE) | ............... 100 32 529 |
| Sep. 1, 2000 | (DE) | ............... 100 43 826 |

(51) Int. Cl.
*C12Q 1/68* (2006.01)
(52) U.S. Cl. ............. 435/6; 435/91.2; 536/24.31; 536/24.33
(58) Field of Classification Search .......... 435/6, 435/91.2; 536/24.31, 24.33
See application file for complete search history.

(56) References Cited

U.S. PATENT DOCUMENTS

| 6,812,339 B1 * | 11/2004 | Venter et al. ............ 536/24.31 |
| 6,977,146 B1 * | 12/2005 | Olek ............................ 435/6 |
| 2003/0036081 A1 | 2/2003 | Adorjan et al. |
| 2003/0113750 A1 | 6/2003 | Distler et al. |

FOREIGN PATENT DOCUMENTS

| WO | WO- 95 11995 A | 5/1995 |
| WO | WO- 99 28498 A | 7/1999 |
| WO | WO 01/68911 A2 | 9/2001 |
| WO | WO 01/68912 A2 | 9/2001 |
| WO | WO 01/76451 A2 | 10/2001 |
| WO | WO 01/77164 A2 | 10/2001 |
| WO | WO 01/77376 A2 | 10/2001 |
| WO | WO 01/77377 A1 | 10/2001 |
| WO | WO 01/81622 A2 | 11/2001 |
| WO | WO 01/92565 A2 | 12/2001 |
| WO | WO 02/00705 A1 | 1/2002 |
| WO | WO 02/00928 A1 | 1/2002 |
| WO | WO 02/02806 A3 | 1/2002 |
| WO | WO 02/02808 A1 | 1/2002 |
| WO | WO 02/012554 A1 | 2/2002 |
| WO | WO 02/36604 A1 | 5/2002 |
| WO | WO 02/36814 A1 | 5/2002 |

OTHER PUBLICATIONS

Herman et al. Methylation-specific PCR: A novel PCR Assay for methylation status of CpG islands. Proc. Natl.Acad. Sci., vol. 93, pp. 9821-9826, 1996.*
Liu et al. Fusion between transcription factor CBF beta/PEBP2 beta and a myosin heavy chain in acute myeloid leukemia. Science, vol. 261 (5124), pp. 1041-1044, 1993.*
Weiler et al. Hybridization based DNA screening on peptide nucleic acid (PNA) oligomer arrays. Nucleic Acids Res., vol. 25, No. 14, pp. 2792-2799, 1997.*
Laken et al. Genotyping by mass spectrometric analysis of short DNA fragments. Nature Biotechnology, vol. 16, pp. 1352-1356, 1998.*
Lowe et al. A computer program for selection of oligonucleotide primers for polymerase chain reactions. Nucleic Acids Research, vol. 18, No. 7, pp. 1757-1761, 1990.*
Rein, T., et al., (1988) "Identifying 5-methylcytosine and related modifications in DNA genomes", Nucleic Acids Research, vol. 26, No. 10 pp. 2255-2264, Oxford University Press.
Olek, A., et al., (1996) "A modified and improved method for bisulphite based cytosine methylation analysis", Nucleic Acids Research, vol. 24, No. 24, pp. 5064-5066.
Zeschnigk, M., et al., (1997) "A single-tube PCR test for the diagnosis of Angelman and Prader-Willi syndrome based on allelic methylation differences at the SNRPN locus" Eur J Hum Genetics, vol. 5, No. 2 pp. 94-98.
Olek, A., et al. (1997) "The pre-implantation ontogeny of the H19 methylation imprint", Nature Genetics, vol. 17, No. 3 pp. 275-276.
Gonzalgo, ML., et al., (1997) "Rapid quantitation of methylation differences at specific sitesusing methylation-sensitive single nucleotide primer extension (Ms-SNuPE)", Nucleic Acids Research, vol. 25, No. 12 pp. 2529-2531.
Xiong, Z., et al., (1997) "COBRA: a sensitive and quantitative DNA methylation assay", Nucleic Acids Research, vol. 25, No. 12 pp. 2532-2534.
Grigg, G., et al., (1994) "Sequencing 5-methylcytosine residues in genomic DNA" Bioessays, vol. 16, No. 6 pp. 431-436.
Zeschnigk, M., et al., (1997) "Imprinted segments in the human genome: different DNA methylation patterns in the Prader-Willi/Angelman syndrome region as determined by the genomic sequencing method", Human Molecular Genetics, vol. 6, No. 3 pp. 387-395.
Feil, R., et al., (1994) "Methylation analysis on individual chromosomes: Improved protocol for bisulphite genomic sequencing" Nucleic Acids Research, vol. 22, No. 4 pp. 695-696.

(Continued)

*Primary Examiner*—Suryaprabha Chunduru
(74) *Attorney, Agent, or Firm*—Barry L. Davison, J.D.; Davis Wright Tremaine LLP

(57) ABSTRACT

Chemically modified genomic sequences of genes associated with gene regulation, to oligonucleotides and/or PNA-oligomers for detecting the cytosine methylation state of genes associated with gene regulation which are directed against the sequence are disclosed. In addition, a method for ascertaining genetic and/or epigenetic parameters of genes associated with gene regulation is disclosed.

22 Claims, 1 Drawing Sheet

OTHER PUBLICATIONS

Figure 1:
Figure 1:
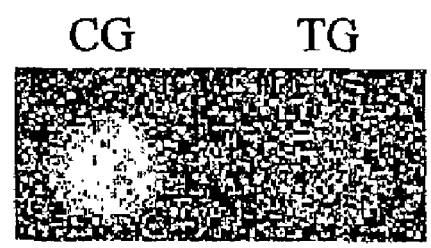

Martin, V., et al., (1995) "Genomic sequencing indicates a correlation between DNA hypomethylation in the 5'region of the pS2 gene and its expression in human breast cancer cell lines" Gene, vol. 157, pp. 261-264.

Database Embl; Accession No. X54156; XP002181265, Abstract.

Herman, James G., et al., "Methylation-Specific PCR: A Novel PCR Assay for Methylation Status of CPG Islands," Preceedings of the National Acadamy of Sciences of USA, National Academy of Science, Washington, US, vol. 93, pp. 9821-9826, 1996.

Mass, Marc J., et al. "Arsenic alters cytosine methylation patterns of the promotor of the tumor suppressor gene P53 in human lung cells: A model for a mechanism of carcinogenesis." vol. 386, No. 3, pp. 263-277, 1997.

Niemeyer C.M., et al., "DNA Microarrays," Angewandte Chemie, VCH Verlagsgesellschaft, Weinheim, DE, vol. 38, No. 19, pp. 3039-3043, 1999.

Rein, Thea, et al., "Identifying 5-methylcytosine and related modifications in DNA genomes" Nucleic Acids Research, Oxford University, Surrey, Great Britain, vol. 26, No. 10, pp. 2255-2264, 1998.

* cited by examiner

I
II

DIAGNOSIS OF DISEASES ASSOCIATED WITH GENE REGULATION

REFERENCE TO SEQUENCE LISTING

1. Field of the Invention

The levels of observation that have been well studied by the methodological developments of recent years in molecular biology, are the genes themselves, the translation of these genes into RNA, and the resulting proteins. The question of which gene is switched on at which point in the course of the development of an individual, and how the activation and inhibition of specific genes in specific cells and tissues are controlled is correlatable to the degree and character of the methylation of the genes or of the genome. In this respect, pathogenic conditions may manifest themselves in a changed methylation pattern of individual genes or of the genome.

The present invention relates to nucleic acids, oligonucleotides, PNA-oligomers and to a method for the diagnosis and/or therapy of diseases which have a connection with the genetic and/or epigenetic parameters of genes associated with gene regulation and, in particular, with the methylation status thereof.

2. Background of the Invention

The completion of the sequencing of the human genome has highlighted the need to further understand the regulation and control of genes. The cell exerts multiple levels of control over genes, however for the majority of genes the most important regulatory mechanism is transcriptional control.

There are multiple mechanisms of gene regulation involving different families of proteins, genes and regulatory sequences. The transcription of eukaryotic genes by polymerases requires the prior assembly of transcription factors at the promoter region of the gene. These factors bind in a specific order, beginning with the binding of TFIID to the TATA box. This provides several stages at which gene regulation may take place, and many eukaryotic gene regulation mechanisms are thought to work by exerting positive or negative control over these processes.

Gene regulatory proteins recognise short stretches of double stranded DNA. Hundreds of such sequences have been identified throughout the genome, e.g. Sp1, which recognises the sequence GGGCGG (in double stranded form), GATA-1 which recognises the sequence TGATAG (in double stranded form) and Oct-1 which recognises ATG-CAAAT (in double stranded form). Gene regulatory proteins contain structural motifs that are able to recognise the regulatory sequences using the unique pattern of hydrogen bond donors, hydrogen bond acceptors and hydrophobic patches in the major and minor groove of the DNA. Several famillies of structural motifs are known, including the helix-turn-helix motif, comprised of amino acids, the zinc finger motif, which utilises one or more molecules of zinc as a structural component, the leucine zipper and helix-loop-helix motif.

Other mechanisms of gene regulation include chromatin packaging. Chromatin that is highly compacted is incapable of transcription, and in a less condensed form, DNA is still packaged on nucleosomes. Nucleosomes positioned at the beginning of a transcription site block the assembly of transcription factors, and these must be removed. In addition gene transcription requires extensive winding and unwinding of the supercoiled DNA. Although the exact mechanisms of DNA packaging are not completely understood, they include the use of a variety of DNA helicases, gyrases and topoisomerases. Further discussion of gene regulation may be found in standard molecular biology textbooks e.g. Alberts et. al. 'Molecular Biology of the cell' Garland Publishing.

Disruptions to gene regulation pathways have been implicated in a wide variety of diseases including, for example, but not limited to:

Severe combined immunodeficiency disease:Misaki et. al. 'Gene-Transferred Oligoclonal T Cells Predominantly Persist in Peripheral Blood from an Adenosine Deaminase-Deficient Patient during Gene Therapy.' Mol Ther 2001 January;3(1):24–27.

Cardiac damage: Pieper et. al. 'Myocardial postischemic injury is reduced by polyADPri-pose polymerase-1 gene disruption.' Mol Med 2000 April;6(4):271–82.

Inflammatory response: Lekstrom-Himes J, Xanthopoulos KG 'CCAAT/enhancer binding protein epsilon is critical for effective neutrophil-mediated response to inflammatory challenge.' Blood 1999 May 1;93(9): 3096–105.

Haemophilia B: Crossley M, Brownlee GG 'Disruption of a C/EBP binding site in the factor IX promoter is associated with haemophilia B.' Nature 1990 May 31;345(6274):444–6.

Werner syndrome: Li B, Comai L 'Requirements for the nucleoytic processing of DNA ends by the Werner syndrome protein:Ku70/80 complex.' J Biol Chem Jan. 4, 2001.

Asthma: Nakamura et. al. 'Gene expression of the GATA-3 transcription factor is increased in atopic asthma.' J Allergy Clin Immunol 1999 February;103(2 Pt 1):215–22.

HDR syndrome: Van Esch et. al. 'GATA3 haplo-insufficiency causes human HDR syndrome.' Nature 2000 July 27;406(6794):419–22.

Congenital heart defects: Srivastava D 'HAND proteins: molecular mediators of cardiac development and congenital heart disease.' Trends Cardiovasc Med 1999 January-February;9(1–2):11–8.

Saethre-Chotzen syndrome: El Ghouzzi et. al. 'Mutations within or upstream of the basic helix-loop-helix domain of the TWIST gene are specific to Saethre-Chotzen syndrome.' Eur J Hum Genet 1999 January;7(1):27–33.

Renal disease: Morello et. al. 'Regulation of glomerular basement membrane collagen expression by LMX1B contributes to renal disease in nail patella syndrome.' Nat Genet. 2001 February;27(2):205–208.

Preeclampsia: Rajakumar et. al. 'Selective Overexpression of the Hypoxia-Inducible Transcription Factor, HIF-2alpha, in Placentas from Women with Preeclampsia.' Biol Reprod. 2001 February;64(2):499–506.

Ogata et. al. 'Inducible expression of basic transcription factor-binding protein 2 (BTEB2), a member of zinc finger family of transcription factors, in cardiac allograft vascular disease.' Transplantation. 2000 December 15;70(11):1653–6.

Colorectal cancer: Rask et. al. 'Increased expression of the transcription factors CCAAT-enhancer binding protein-beta (C/EBBeta) and C/EBzeta (CHOP)correlate with invasive-ness of human colorectal cancer.' Int J Cancer. 2000 May 1;86(3):337–43.

Thyroid cancer: Kebebew et. al. 'The helix-loop-helix transcription factor, Id-1, is over-expressed in medullary thyroid cancer' Surgery. 2000 December; 128(6): 952–7.

Esophagal cancer: Saeki et. al. 'Expression of ets-1 transcription factor is correlated with penetrating tumor progression in patients with squamous cell carcinoma of the esophagus' Cancer. 2000 October 15;89(8): 1670–6.

The diversity of mechanisms involved in the regulation of genes provides an alternative level at which to target therapies and diagnosis for diseases. In particular this may be relevant to diseases where current therapies may have unwanted side effects or fail to provide effective treatment. For cancer patients such methods constitute a considerable advantage over conventional methods such as chemotherapy with their massive side effects, which sometimes result in unacceptable morbidity or lead up to the death of the patient. In practice, these unwanted side effects associated with cancer therapies frequently limit the treatment which could help a patient.

A global analysis of the status of gene regulatory mechanisms would provide a basis for the development of appropriate and specific therapies for the many diseases associated with gene regulation. Such analysis may be carried out in a gene specific manner based on the results of gene expression, e.g. DNA micro array analysis of mRNA expression or proteomic analysis. The next step would then be to look at the causal factors involved at earlier stages in the regulatory mechanisms. DNA methylation provides a novel level of information at which to analyse the genome.

5-methylcytosine is the most frequent covalent base modification in the DNA of eukaryotic cells. It plays a role, for example, in the regulation of the transcription, in genetic imprinting, and in tumorigenesis. Therefore, the identification of 5-methylcytosine as a component of genetic information is of considerable interest. However, 5-methylcytosine positions cannot be identified by sequencing since 5-methylcytosine has the same base pairing behavior as cytosine. Moreover, the epigenetic information carried by 5-methylcytosine is completely lost during PCR amplification.

A relatively new and currently the most frequently used method for analyzing DNA for 5-methylcytosine is based upon the specific reaction of bisulfite with cytosine which, upon subsequent alkaline hydrolysis, is converted to uracil which corresponds to thymidine in its base pairing behavior. However, 5-methylcytosine remains unmodified under these conditions. Consequently, the original DNA is converted in such a manner that methylcytosine, which originally could not be distinguished from cytosine by its hybridization behavior, can now be detected as the only remaining cytosine using "normal" molecular biological techniques, for example, by amplification and hybridization or sequencing. All of these techniques are based on base pairing which can now be fully exploited. In terms of sensitivity, the prior art is defined by a method which encloses the DNA to be analyzed in an agarose matrix, thus preventing the diffusion and renaturation of the DNA (bisulfite only reacts with single-stranded DNA), and which replaces all precipitation and purification steps with fast dialysis (Olek A, Oswald J, Walter J. A modified and improved method for bisulphite based cytosine methylation analysis. Nucleic Acids Res. 1996 Dec. 15;24(24):5064–6). Using this method, it is possible to analyze individual cells, which illustrates the potential of the method. However, currently only individual regions of a length of up to approximately 3000 base pairs are analyzed, a global analysis of cells for thousands of possible methylation events is not possible. However, this method cannot reliably analyze very small fragments from small sample quantities either. These are lost through the matrix in spite of the diffusion protection.

An overview of the further known methods of detecting 5-methylcytosine may be gathered from the following review article: Rein, T., DePamphilis, M. L., Zorbas, H., Nucleic Acids Res. 1998, 26,2255.

To date, barring few exceptions (e.g., Zeschnigk M, Lich C, Buiting K, Doerfler W, Horsthemke B. A single-tube PCR test for the diagnosis of Angelman and Prader-Willi syndrome based on allelic methylation differences at the SNRPN locus. Eur J Hum Genet. 1997 March-April;5(2): 94–8) the bisulfite technique is only used in research. Always, however, short, specific fragments of a known gene are amplified subsequent to a bisulfite treatment and either completely sequenced (Olek A, Walter J. The pre-implantation ontogeny of the H19 methylation imprint. Nat Genet. 1997 November;17(3):275–6) or individual cytosine positions are detected by a primer extension reaction (Gonzalgo M L, Jones P A. Rapid quantitation of methylation differences at specific sites using methylation-sensitive single nucleotide primer extension (Ms-SNuPE). Nucleic Acids Res. 1997 June 15;25(12):2529–31, Patent application WO 95/00669) or by enzymatic digestion (Xiong Z, Laird PW. COBRA: a sensitive and quantitative DNA methylation assay. Nucleic Acids Res. 1997 June 15;25(12):2532–4). In addition, detection by hybridization has also been described (Olek et al., WO 99/28498).

Further publications dealing with the use of the bisulfite technique for methylation detection in individual genes are: Grigg G, Clark S. Sequencing 5-methylcytosine residues in genomic DNA. Bioessays. 1994 June;16(6):431–6, 431; Zeschnigk M, Schmitz B, Dittrich B, Buiting K, Horsthemke B, Doerfler W. Imprinted segments in the human genome: different DNA methylation patterns in the Prader-Willi/ Angelman syndrome region as determined by the genomic sequencing method. Hum Mol Genet. 1997 March;6(3): 387–95; Feil R, Charlton J, Bird AP, Walter J, Reik W. Methylation analysis on individual chromosomes: improved protocol for bisulphite genomic sequencing. Nucleic Acids Res. 1994 February 25;22(4):695–6; Martin V, Ribieras S, Song-Wang X, Rio MC, Dante R. Genomic sequencing indicates a correlation between DNA hypomethylation in the 5' region of the pS2 gene and its expression in human breast cancer cell lines. Gene. 1995 May 19;157(1–2):261-4; WO 97/46705, WO 95/15373 and WO 97/45560.

An overview of the Prior Art in oligomer array manufacturing can be gathered from a special edition of Nature Genetics (Nature Genetics Supplement, Volume 21, January 1999), published in January 1999, and from the literature cited therein.

Fluorescently labeled probes are often used for the scanning of immobilized DNA arrays. The simple attachment of Cy3 and Cy5 dyes to the 5'-OH of the specific probe are particularly suitable for fluorescence labels. The detection of the fluorescence of the hybridized probes may be carried out, for example via a confocal microscope. Cy3 and Cy5 dyes, besides many others, are commercially available.

Matrix Assisted Laser Desorption Ionization Mass Spectrometry (MALDI-TOF) is a very efficient development for the analysis of biomolecules (Karas M, Hillenkamp F. Laser desorption ionization of proteins with molecular masses exceeding 10,000 daltons. Anal Chem. 1988 October 15;60 (20):2299–301). An analyte is embedded in a light-absorbing matrix. The matrix is evaporated by a short laser pulse thus transporting the analyte molecule into the vapor phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones.

MALDI-TOF spectrometry is excellently suited to the analysis of peptides and proteins. The analysis of nucleic acids is somewhat more difficult (Gut I G, Beck S. DNA and Matrix Assisted Laser Desorption Ionization Mass Spectrometry. Current Innovations and Future Trends. 1995, 1; 147–57). The sensitivity to nucleic acids is approximately 100 times worse than to peptides and decreases disproportionally with increasing fragment size. For nucleic acids having a multiply negatively charged backbone, the ionization process via the matrix is considerably less efficient. In MALDI-TOF spectrometry, the selection of the matrix plays an eminently important role. For the desorption of peptides, several very efficient matrixes have been found which produce a very fine crystallization. There are now several responsive matrixes for DNA, however, the difference in sensitivity has not been reduced. The difference in sensitivity can be reduced by chemically modifying the DNA in such a manner that it becomes more similar to a peptide. Phosphorothioate nucleic acids in which the usual phosphates of the backbone are substituted with thiophosphates can be converted into a charge-neutral DNA using simple alkylation chemistry (Gut IG, Beck S. A procedure for selective DNA alkylation and detection by mass spectrometry. Nucleic Acids Res. 1995 April 25;23(8):1367–73). The coupling of a charge tag to this modified DNA results in an increase in sensitivity to the same level as that found for peptides. A further advantage of charge tagging is the increased stability of the analysis against impurities which make the detection of unmodified substrates considerably more difficult.

Genomic DNA is obtained from DNA of cell, tissue or other test samples using standard methods. This standard methodology is found in references such as Fritsch and Maniatis eds., Molecular Cloning: A Laboratory Manual, 1989.

SUMMARY OF THE INVENTION

The object of the present invention is to provide the chemically modified DNA of genes associated with gene regulation, as well as oligonucleotides and/or PNA-oligomers for detecting cytosine methylations, as well as a method which is particularly suitable for the diagnosis and/or therapy of genetic and epigenetic parameters of genes associated with gene regulation. The present invention is based on the discovery that genetic and epigenetic parameters and, in particular, the cytosine methylation pattern of genes associated with gene regulation are particularly suitable for the diagnosis and/or therapy of diseases associated with gene regulation.

This objective is achieved according to the present invention using a nucleic acid containing a sequence of at least 18 bases in length of the chemically pretreated DNA of genes associated with gene regulation according to one of Seq. ID No.1 through Seq. ID No.224 and sequences complementary thereto and/or a sequence of a chemically pretreated DNA of genes according to table 1 and sequences complementary thereto. In the table, after the listed gene designations, the respective data bank numbers (accession numbers) are specified which define the appertaining gene sequences as unique. GenBank was used as the underlying data bank, which is located at the National Institute of Health, internet address www.ncbi.nlm.nih.gov.

The chemically modified nucleic acid could heretofore not be connected with the ascertainment of genetic and epigenetic parameters.

The object of the present invention is further achieved by an oligonucleotide or oligomer for detecting the cytosine methylation state in chemically pretreated DNA, containing at least one base sequence having a length of at least 13 nucleotides which hybridizes to a chemically pretreated DNA of genes associated with gene regulation according to Seq. ID No.1 through Seq. ID No.224 and sequences complementary thereto and/or a sequence of a chemically pre-treated DNA of genes according to table 1 and sequences complementary thereto. The oligomer probes according to the present invention constitute important and effective tools which, for the first time, make it possible to ascertain the genetic and epigenetic parameters of genes associated with gene regulation. The base sequence of the oligomers preferably contains at least one CpG dinucleotide. The probes may also exist in the form of a PNA (peptide nucleic acid) which has particularly preferred pairing properties. Particularly preferred are oligonucleotides according to the present invention in which the cytosine of the CpG dinucleotide is the $5^{th}$–$9^{th}$ nucleotide from the 5'-end of the 13-mer; in the case of PNA-oligomers, it is preferred for the cytosine of the CpG dinucleotide to be the $4^{th}$–$6^{th}$ nucleotide from the 5'-end of the 9-mer.

The oligomers according to the present invention are normally used in so called "sets" which contain at least one oligomer for each of the CpG dinucleotides of the sequences of Seq. ID No.1 through Seq. ID No.224 and sequences complementary thereto and/or a sequence of a chemically pretreated DNA of genes according to table 1 and sequences complementary thereto. Preferred is a set which contains at least one oligomer for each of the CpG dinucleotides from one of Seq. ID No.1 through Seq. ID No.224 and sequences complementary thereto and/or a sequence of a chemically pretreated DNA of genes according to table 1 and sequences complementary thereto.

Moreover, the present invention makes available a set of at least two oligonucleotides which can be used as so-called "primer oligonucleotides" for amplifying DNA sequences of one of Seq. ID No.1 through Seq. ID No.224 and sequences complementary thereto and/or a sequence of a chemically pretreated DNA of genes according to table 1 and sequences complementary thereto, or segments thereof.

In the case of the sets of oligonucleotides according to the present invention, it is preferred that at least one oligonucleotide is bound to a solid phase.

The present invention moreover relates to a set of at least 10 n (oligonucleotides and/or PNA-oligomers) used for detecting the cytosine methylation state in chemically pretreated genomic DNA (Seq. ID No.1 through Seq. ID No.224 and sequences complementary thereto and/or a sequence of a chemically pretreated DNA of genes according to table 1 and sequences complementary thereto). These probes enable diagnosis and/or therapy of genetic and epigenetic parameters of genes associated with gene regulation. The set of oligomers may also be used for detecting single nucleotide polymorphisms (SNPs) in the chemically pretreated DNA of genes associated with gene regulation according to one of Seq. ID No.1 through Seq. ID No.224 and sequences complementary thereto and/or a sequence of a chemically pretreated DNA of genes to according to table 1 and sequences complementary thereto.

According to the present invention, it is preferred that an arrangement of different oligonucleotides and/or PNA-oligomers (a so-called "array") made available by the present invention is present in a manner that it is likewise bound to a solid phase. This array of different oligonucleotide- and/or PNA-oligomer sequences can be characterized in that it is arranged on the solid phase in the form of a rectangular or hexagonal lattice. The solid phase surface is preferably composed of silicon, glass, polystyrene, aluminum, steel, iron, copper, nickel, silver, or gold. However, nitrocellulose as well as plastics such as nylon which can exist in the form of pellets or also as resin matrices are possible as well.

Therefore, a further subject matter of the present invention is a method for manufacturing an array fixed to a carrier material for analysis in connection with diseases associated with gene regulation in which method at least one oligomer according to the present invention is coupled to a solid phase. Methods for manufacturing such arrays are known, for example, from U.S. Pat. No. 5,744,305 by means of solid-phase chemistry and photolabile protecting groups.

A further subject matter of the present invention relates to a DNA chip for the analysis of diseases associated with gene regulation which contains at least one nucleic acid according to the present invention. DNA chips are known, for example, from U.S. Pat. No. 5,837,832.

Moreover, a subject matter of the present invention is a kit which may be composed, for example, of a bisulfite-containing reagent, a set of primer oligonucleotides containing at least two oligonucleotides whose sequences in each case correspond or are complementary to an 18 base long segment of the base sequences specified in the appendix (Seq. ID No.1 through Seq. ID No.224 and sequences complementary thereto and/or a sequence of a chemically pretreated DNA of genes according to table 1 and sequences complementary thereto), oligonucleotides and/or PNA-oligomers as well as instructions for carrying out and evaluating the described method. However, a kit along the lines of the present invention can also contain only part of the aforementioned components.

The present invention also makes available a method for ascertaining genetic and/or epigenetic parameters of genes associated with the cycle cell by analyzing cytosine methylations and single nucleotide polymorphisms, including the following steps:

In the first step of the method, a genomic DNA sample is chemically treated in such a manner that cytosine bases which are unmethylated at the 5'-position are converted to uracil, thymine, or another base which is dissimilar to cytosine in terms of hybridization behavior. This will be understood as 'chemical pretreatment' hereinafter.

The genomic DNA to be analyzed is preferably obtained form usual sources of DNA such as cells or cell components, for example, cell lines, biopsies, blood, sputum, stool, urine, cerebral-spinal fluid, tissue embedded in paraffin such as tissue from eyes, intestine, kidney, brain, heart, prostate, lung, breast or liver, histologic object slides, or combinations thereof.

The above described treatment of genomic DNA is preferably carried out with bisulfite (hydrogen sulfite, disulfite) and subsequent alkaline hydrolysis which results in a conversion of non-methylated cytosine nucleobases to uracil or to another base which is dissimilar to cytosine in terms of base pairing behavior.

Fragments of the chemically pretreated DNA are amplified, using sets of primer oligonucleotides according to the present invention, and a, preferably heat-stable polymerase. Because of statistical and practical considerations, preferably more than ten different fragments having a length of 100–2000 base pairs are amplified. The amplification of several DNA segments can be carried out simultaneously in one and the same reaction vessel. Usually, the amplification is carried out by means of a polymerase chain reaction (PCR).

In a preferred embodiment of the method, the set of primer oligonucleotides includes at least two olignonucleotides whose sequences are each reverse complementary or identical to an at least 18 base-pair long segment of the base sequences specified in the appendix (Seq. ID No.1 through Seq. ID No.224 and sequences complementary thereto and/or a sequence of a chemically pretreated DNA of genes according to table 1 and sequences complementary thereto). The primer oligonucleotides are preferably characterized in that they do not contain any CpG dinucleotides.

According to the present invention, it is preferred that at least one primer oligonucleotide is bonded to a solid phase during amplification. The different oligonucleotide and/or PNA-oligomer sequences can be arranged on a plane solid phase in the form of a rectangular or hexagonal lattice, the solid phase surface preferably being composed of silicon, glass, polystyrene, aluminum, steel, iron, copper, nickel, silver, or gold, it being possible for other materials such as nitrocellulose or plastics to be used as well.

The fragments obtained by means of the amplification can carry a directly or indirectly detectable label. Preferred are labels in the form of fluorescence labels, radionuclides, or detachable molecule fragments having a typical mass which can be detected in a mass spectrometer, it being preferred that the fragments that are produced have a single positive or negative net charge for better detectability in the mass spectrometer. The detection may be carried out and visualized by means of matrix assisted laser desorption/ionization mass spectrometry (MALDI) or using electron spray mass spectrometry (ESI).

The amplificates obtained in the second step of the method are subsequently hybridized to an array or a set of oligonucleotides and/or PNA probes. In this context, the hybridization takes place in the manner described in the following. The set of probes used during the hybridization is preferably composed of at least 10 oligonucleotides or PNA-oligomers. In the process, the amplificates serve as probes which hybridize to oligonucleotides previously bonded to a solid phase. The non-hybridized fragments are subsequently removed. Said oligonucleotides contain at least one base sequence having a length of 13 nucleotides which is reverse complementary or identical to a segment of the base sequences specified in the appendix, the segment containing at least one CpG dinucleotide. The cytosine of the CpG dinucleotide is the $5^{th}$ to $9^{th}$ nucleotide from the 5'-end of the 13-mer. One oligonucleotide exists for each CpG dinucleotide. Said PNA-oligomers contain at least one base sequence having a length of 9 nucleotides which is reverse complementary or identical to a segment of the base sequences specified in the appendix, the segment containing at least one CpG dinucleotide. The cytosine of the CpG dinucleotide is the $4^{th}$ to $6^{th}$ nucleotide seen from the 5'-end of the 9-mer. One oligonucleotide exists for each CpG dinucleotide.

In the fourth step of the method, the non-hybridized amplificates are removed.

In the final step of the method, the hybridized amplificates are detected. In this context, it is preferred that labels attached to the amplificates are identifiable at each position of the solid phase at which an oligonucleotide sequence is located.

According to the present invention, it is preferred that the labels of the amplificates are fluorescence labels, radionuclides, or detachable molecule fragments having a typical mass which can be detected in a mass spectrometer. The mass spectrometer is preferred for the detection of the amplificates, fragments of the amplificates or of probes which are complementary to the amplificates, it being possible for the detection to be carried out and visualized by means of matrix assisted laser desorption/ionization mass spectrometry (MALDI) or using electron spray mass spectrometry (ESI).

The produced fragments may have a single positive or negative net charge for better detectability in the mass spectrometer. The aforementioned method is preferably used for ascertaining genetic and/or epigenetic parameters of genes associated with gene regulation.

The oligomers according to the present invention or arrays thereof as well as a kit according to the present invention are intended to be used for the diagnosis and/or therapy of diseases associated with gene regulationby analyzing methylation patterns of genes associated with gene regulation. According to the present invention, the method is preferably used for the diagnosis and/or therapy of important genetic and/or epigenetic parameters within genes associated with gene regulation.

The method according to the present invention is used, for example, for the diagnosis and/or therapy of severe combined immunodeficiency disease, cardiac disorders, inflammatory response, heamophilia, Werner syndrome, asthma, HDR syndrome, Saethre-Chotzen syndrome, renal disease, preeclampsia, graft-versus-host disease, solid tumors and cancers.

The nucleic acids according to the present invention of Seq. ID No.1 through Seq. ID No.224 and sequences complementary thereto and/or a sequence of a chemically pretreated DNA of genes according to table 1 and sequences complementary thereto can be used for the diagnosis and/or therapy of genetic and/or epigenetic parameters of genes associated with gene regulation.

The present invention moreover relates to a method for manufacturing a diagnostic agent and/or therapeutic agent for the diagnosis and/or therapy of diseases associated with gene regulationby analyzing methylation patterns of genes associated with gene regulation, the diagnostic agent and/or therapeutic agent being characterized in that at least one nucleic acid according to the present invention is used for manufacturing it, possibly together with suitable additives and auxiliary agents.

A further subject matter of the present invention relates to a diagnostic agent and/or therapeutic agent for diseases associated with gene regulationby analyzing methylation patterns of genes associated with gene regulation, the diagnostic agent and/or therapeutic agent containing at least one nucleic acid according to the present invention, possibly together with suitable additives and auxiliary agents.

The present invention moreover relates to the diagnosis and/or prognosis of events which are disadvantageous to patients or individuals in which important genetic and/or epigenetic parameters within genes associated with gene regulation said parameters obtained by means of the present invention may be compared to another set of genetic and/or epigenetic parameters, the differences serving as the basis for a diagnosis and/or prognosis of events which are disadvantageous to patients or individuals.

In the context of the present invention the term "hybridization" is to be understood as a bond of an oligonucleotide to a completely complementary sequence along the lines of the Watson-Crick base pairings in the sample DNA, forming a duplex structure. To be understood by "stringent hybridization conditions" are those conditions in which a hybridization is carried out at 60° C. in 2.5×SSC buffer, followed by several washing steps at 37° C. in a low buffer concentration, and remains stable.

The term "functional variants" denotes all DNA sequences which are complementary to a DNA sequence, and which hybridize to the reference sequence under stringent conditions and have an activity similar to the corresponding polypeptide according to the present invention.

In the context of the present invention, "genetic parameters" are mutations and polymorphisms of genes associated with gene regulationand sequences further required for their regulation. To be designated as mutations are, in particular, insertions, deletions, point mutations, inversions and polymorphisms and, particularly preferred, SNPs (single nucleotide polymorphisms).

In the context of the present invention, "epigenetic parameters" are, in particular, cytosine methylations and further chemical modifications of DNA bases of genes associated with gene regulationand sequences further required for their regulation. Further epigenetic parameters include, for example, the acetylation of histones which, however, cannot be directly analyzed using the described method but which, in turn, correlates with the DNA methylation.

In the following, the present invention will be explained in greater detail on the basis of the sequences and examples with reference to the accompanying figure without being limited thereto.

FIG. 1

FIG. 1 shows the hybridisation of fluorescent labelled amplificates to a surface bound olignonucleotide. Sample I being from pilocytic astrocytoma (brain tumor) tissue and sample II being from grade II astrocytoma (brain tumor) tissue. Flourescence at a spot shows hybridisation of the amplificate to the olignonucleotide. Hybridisation to a CG olignonucleotide denotes methylation at the cytosine position being analysed, hybridisation to a TG olignonucleotide denotes no methylation at the cytosine position being analysed.

Sequence ID Nos. 1 to 224

Sequence ID Nos. 1 to 224 show sequences of genes associated with gene regulation according to the invention. Sequences having odd sequence numbers (e.g., Seq. ID No. 1, 3, 5, . . . ) exhibit in each case sequences of the chemically pretreated genomic DNAs of different genes associated with gene regulation. Sequences having even sequence numbers (e.g., Seq. ID No. 2, 4, 6, . . . ) exhibit in each case the sequences of the chemically pretreated genomic DNAs of genes associated with gene regulationwhich are complementary to the preceeding sequences (e.g., the complementary sequence to Seq. ID No.1 is Seq. ID No.2, the complementary sequence to Seq. ID No.3 is Seq. ID No.4, etc.)

Sequence ID Nos. 225 to 228

Sequence ID Nos. 225 to 228 show the sequences of oligonucleotides used in Example 1.

EXAMPLE 1

Methylation Analysis of the Gene p53 Associated with Gene Regulation.

This example relates to a fragment of a gene associated with gene regulation, in this case, p53 in which a specific CG-position is analyzed for its methylation status.

In the first step, a genomic sequence is treated using bisulfite (hydrogen sulfite, disulfite) in such a manner that all cytosines which are not methylated at the 5-position of the base are modified in such a manner that a different base is substituted with regard to the base pairing behavior while the cytosines methylated at the 5-position remain unchanged.

If bisulfite solution is used for the reaction, then an addition takes place at the non-methylated cytosine bases. Moreover, a denaturating reagent or solvent as well as a radical interceptor must be present. A subsequent alkaline hydrolysis then gives rise to the conversion of non-methylated cytosine nucleobases to uracil. The chemically converted DNA (Seq ID No. 221) is then used for the detection of methylated cytosines. In the second step of the method, the treated DNA sample is diluted with water or an aqueous solution. Preferably, the DNA is subsequently desulfonated (10–30 min, 90–100° C.) at an alkaline pH value. In the third step of the method, the DNA sample is amplified in a polymerase chain reaction, preferably using a heat-resistant DNA polymerase. In the present case, cytosines of the gene p53 are analyzed. To this end, a defined fragment having a length of 595 bp is amplified with the specific primer oligo-nucleotides GTGATAAGGGTTGTGAAGGA (sequence ID No.225) and CAAAAACTTACCCAATCCAA (sequence ID No.226). This amplificate serves as a sample which hybridizes to an oligonucleotide previously bonded to a solid phase, forming a duplex structure, for example AACCCCTACGAAACTCCT (sequence ID No.227), the cytosine to be detected being located at position 401 of the amplificate. The detection of the hybridization product is based on Cy3 and Cy5 flourescently labeled primer oligonucleotides which have been used for the amplification. A hybridization reaction of the amplified DNA with the oligonucleotide takes place only if a methylated cytosine was present at this location in the bisulfite-treated DNA. Thus, the methylation status of the specific cytosine to be analyzed is inferred from the hybridization product.

In order to verify the methylation status of the position, a sample of the amplificate is further hybridized to another oligonucleotide previously bonded to a solid phase. Said olignonucleotide is identical to the oligonucleotide previously used to analyze the methylation status of the sample, with the exception of the position in question. At the position to be analysed said oligonucleotide comprises a thymine base as opposed to a cytosine base i.e. sequence AACCCCTACAAAACTCCT (sequence ID No.228). Therefore, the hybridization reaction only takes place if an unmethylated cytosine was present at the position to be analysed.

The analysis was carried out on two tissue samples, Sample I from pilocytic astrocytoma (brain tumor) tissue, and Sample 2 from grade II astrocytoma (brain tumor) tissue. From the results (FIG. 1) it can be seen that Sample 2 was methylated at position 401 of the amplificate whereas Sample 1 contained a mixture of both methylated and unmethylated cells at the same position.

EXAMPLE 2

Diagnosis of Diseases Associated with Gene Regulation

In order to relate the methylation patterns to one of the diseases associated with gene regulation, it is initially required to analyze the DNA methylation patterns of a group of diseased and of a group of healthy patients. These analyses are carried out, for example, analogously to example 1. The results obtained in this manner are stored in a database and the CpG dinucleotides which are methylated differently between the two groups are identified. This can be carried out by determining individual CpG methylation rates as can be done, for example, in a relatively imprecise manner, by sequencing or else, in a very precise manner, by a methylation-sensitive "primer extension reaction". It is also possible for the entire methylation status to be analyzed simultaneously, and for the patterns to be compared, for example, by clustering analyses which can be carried out, for example, by a computer.

Subsequently, it is possible to allocate the examined patients to a specific therapy group and to treat these patients selectively with an individualized therapy.

Example 2 can be carried out, for example, for the following diseases: severe combined immunodeficiency disease, cardiac disorders, inflammatory response, heamophilia, Werner syndrome, asthma, HDR syndrome, Saethre-Chotzen syndrome, renal disease, preeclampsia, graft-versus-host disease, solid tumors and cancers.

TABLE 1

Listing of preferred genes associated with gene regulation according to the invention.

| Gene | Database entry No. (GenBank) |
| --- | --- |
| CBFB | (L20298), |
| ELF1 | (M82882), |
| ETV3 | (L16464), |
| ETV4 | (D12765), |
| LYL1 | (M22637), |
| RENBP | (U52112), |
| TAF2C2 | (Y09321), |
| TCF3 | (M31222), |
| H4FI | (NM_003544), |
| ADA | (NM_000022), |
| ATF3 | (NM_001674), |
| CEBPD | (NM_005195), |
| CHD1L | (NM_004284), |
| CTPS | (NM_001905), |
| DCTD | (NM_001921), |
| EIF2B1 | (NM_001414), |
| ELF3 | (NM_004433), |
| ELK4 | (NM_021795), |
| ETV5 | (NM_004454), |
| FOXO1A | (NM_002015), |
| HIVEP1 | (NM_002114), |
| HMG2 | (NM_002129), |
| ID1 | (NM_002165), |
| ID3 | (NM_002167), |
| ID4 | (NM_001546), |
| LAF4 | (NM_0022859), |
| MAFG | (NM_002359), |
| MHC2TA | (NM_000246), |
| ODC1 | (NM_002539), |
| PBX3 | (NM_006195), |
| PCNA | (NM_002592), |
| POU2AF1 | (NM_006235), |
| PRPS1 | (NM_002764), |
| RARG | (NM_000966), |
| RECQL | (NM_002907), |
| RXRA | (NM_002957), |
| TIAL1 | (NM_003252), |
| ZNF173 | (NM_003449), |
| ATBF1 | (NM_006885), |
| FLI1 | (NM_002017), |
| NUMA1 | (NM_006185), |
| POU2F2 | (NM_002698), |
| SF100 | (NM_003113) |

SEQUENCE LISTING (228 sequences)

SEQ ID NO: 1 - DNA, 10619 bp, Artificial Sequence
  chemically treated genomic DNA (Homo sapiens)
gttttatttgtttaataggaaatttttggtgtggggttttagatattttttttattttattattatatatatatatattagtagttagaattgtgtgtttttttttttttttttttttttttttgatatagagttttggtttgtcgattaggttggagtgtagtggtgtaatttcggtttattgtaatttttgttttttaagattaagggatttttttgttttagttttttgagtagtttggattataggtatgtattattatgtttagttaattgttttgtatttttagtagagatagggttttatcgtgttagttaggttggttttaaatttttgattttgtgattcgtttgttttggttttttaaagtgttgggattataggtacgagttattattttttttttttatttttgattaattttgataaaatataaaattaaattaagataaattaattttgtaaaataaagataaagttggaggttttatattttttgattttaaaatttattatgatgtggcgttggaataaagataaatatatagattaatggaatagaatagagagtttaaaaataaatttttaatatatatggttaaatgattttaataagggtgttaagattatttagtgggaaaaggatagttttttttatagatggtggatttttatatgtagaagaatgtagttggatttatattttatattaaatgtttgttgtgagtttatttatttttttgtgtgtgtggagatagggtcgtgttatgttgtttaggttgatttagaattttttatttagagatattgttaaggtaagtgagggttaagtggatattgagtgattttgtgttttattgagtaaaaataattaaatatgggcgaaggagagtttaatgattttagggataaaatgttattacgggtattttgcgtacgtttgttaggatataggagaagtaattagatattttatttatttttttagaatgtttattaatatgtttagaaaggtggaaaattttatttgttaaagagaaggaaattggaggtatggttaaaagtatttaaggttttttatgaaaaagaaatgaaaattgatattttttttaaaagagaagtaaaatagaaatttagagattttaatgtattcgaaaggttttttttgggtttttattttgtgttttgagtattgtttttaaattaaaggagatttcggtttgtttattggtagtgatgttaagaatttgggagggatatgagtgattatgttgtagatggtaagtagtttaaaaagaaggttttttaattgaaggaaaagtattaagagtagaatgttgtatatttagttaaaggaaagttgatgtggtaaaaatgatgttgttaaggtcgaaaaaggtaagaaaaaaaaataaagcggagaaagatagagaaggtaaggaaaataaaaaatgaagtcgatgataatgataaataaggtggttttatggtagtttttttttttttttttttgtttataaagtatttaatttatttggatatagtttattttttttaaagaaaaaaattgaaatgtaaagttatttaagatttatttgtaaattgtatgatggcgttttttttttgtttttgtattattaataagaattattaagtaattttttagataattttgttttggtggtattttgtatagttattaattttgtttggtatattataggggttataaattagtatgggaattttaaatttaaggtatagtataagttagttatatataaatgtgaagtaatattattaattaaattgttggtttgtgcgaagggagggttaattgtgggatttagttatttatttaataaatattggtgagtgtttgatattgttttaggtattgaggttattgtaataaaatagatataagtttttgtttttatggagtttatattttggtgagggatatagagttattaaaaaggatggtagttgggttatgagaaaggattaaagttaggaagttagaattcggggatggattgaatatgggataaaagagaagagttaagttgattataaagtatttggtttaagtaatgtaaagaatggtgggttattttttgagatgggaagtattagggtagttttggatataaatggagatgtatataagttatttaaattgaaatattgagaaggtagtaggtgatagttggttttttttaggttttagggtaggaatttttaattttttgtgtgtgtgtttaggatttttttggtggtttatgaagttttttttagaataaatattgtggaggaatttattttaatgtaatagtagtttttaggtatattattaggtaaattattttataagttataaaatagaaagttttatagattaaattatgatgtttgaattgtaggtttattgaattagtttaaaattatttatagtaagaattcgatggggtgtatgatatatataggatagggtataggcgaggtagatggattatattattagaatttagaattagggaattttttttttttttttttttttttttttttttgagattgttttattatgttgtttaggttggagtgtaatggcgtgatttcggtttattgtaatttttattttttgggtttaagcgatttttatgttttagtttttcgagtagttgggattataggtacgtattataatgtttagttaatttttgtatttttagtagagacggggttttattatgttgattaggttggttttgaatttttgattttaggtgatttattcgttttagatttttaaagcgttgggattataggtatgagttattgtatttggttaatattgatatgttttttttttttttgtcgtattagtttgttttattgatagagttgaggatgtttaaggcggtttaatagagggtatttggagtaatttatattgtattattagagagatataagtgtaagtatatttagttatagttgtagtttattaattagtttgttgaatagatttgaattttagttgtatttttggggtagagtatatgggtgttaggatgggattataattttattattaatgagtggttatttagggatgatatagttgttaatttagagatggtatgattatgttttttgatttggttattttttaagtaaaatttttatttgttttattatattttttatttattttgtttatttttaaaatattttttttttttttttgagatagggttatattgttatttaggttagagtttagtggtattattatggtttattatagttttaatttttagggtttaggtgatttttttattttagtttttcgagtagatgggattataggtatttgttattatttttagttaatttttgtagagataaggttttgttatgttgtttaggttggttttgaatttttgggtttaagggattcggttattttagttttttaaagtgttaggattataggtatgagttattgtgtttagtttatttttaacgtatttaattggttattaatttttaggattcggtttatgttttataatttttttgtttatttaatatttttgttttttaagttattagttttttttttatggttaatattttttatgagttttatttatttgtttattttttttattttttatattagaattgaatatttttaaataaagtatatttatgttataatttttgaaatgaaaaaaaaaatgtataggattagaaaagaaattaattttaataaattatattttgaagtatagttttatattaaataataagatttaggttaggtgtagtggtttatgtttgtaattttagtaatttgggaagtcgaggtgggaggattgtttgaggttaggggtttaagattagtttgggtaatatggagagattttttatttttttttttatatatatatatatatatatatatatatataaaatatttgatagtaataggtgttgttattattataatttcgagtagtgatgagtttaataatatttcgagttattattaataattgtaaagtaatatgaaaacgtttgtgatgattattgtttataaagttataggtattgttaatatttttggtatttgtagttaaatttataataaaggaaatgttaggttttagttggtattttgtttcgacggtttgtggacggtaggttagaacgttcgtttaagttaggagggtggatttagtattgtagggtttatttcgggttaattaattatattttcgaggcgggggttcggtttttcggatttagttgtttttaggggagagaggatatatttaagagtttggggtcggcgtggtagtatatgtttttgattttagtatttcgggaggttgaggcgtgaagattatttgtagtaggagtttgagattagtttagttaatttggcgagattttgtttttaaaaaaaatttttttttaattagttagttgtggtgagcgtttgtagttttagttattcgggaggttgaggtgggaggatcgttgggtttaggagttttagattgtagtgagttatgatggcggtattgtattttagcgcggtgagatttagttttaaaaataaaagggggaggggttgggggtaaaattagttgtgaaattaagtaagattttttgggatagaataattaaaggggtggcgtcgggttttttaaagagttattagtttagtttaagtttcgtttcggtttttaggtagcggtcgtagagttttattcggtaggcgttcgggaaatttcgtttttcggtcggtagggggcgcgcgtcgtcggtttcgtttcgtggacgcgggtttcgtgggcgttttcgcggttaggtattagtaatttattagggaacggcggtggtcggtgcggcgtgttcggtggcggttttggtcgtttaagagttgcggttgggtgagcgtacgcgaggcggcgaggcggtagcgtgtttttaggtcgtggcgtcgggttttcggagttttggcggtagttaggggaggatggcggagttttcggataagttttatcgagtcgagtacgttaagagcgggcgcgttttttgtaagaaatgtagcgagagtatttttaaggattcgtttcggatggttattatggtgtaggtgcgggttttgtgcgggcggcggggcggggacgcggcgtttcgggttaattgtgttcgggaaggttgggggagggcggttttagggagcgagcgggttcgggttcgggttttcggagcggtatttggggtttatgggttcgcggtcgttttttttttcgagcggttcggtcgattttttcggaaggttttgttgatgttgtaggaaaagttcgggaaataaagtttgtagttggtgttgtttttcgttttgtgaaaacgaggagttttttttttttttttttttgggtggcggtgttttattattgtcgttcgttttaggggttgggggggaattgtatatggtttttttaagttaatttgattttgatttattttgttttggagggtttttgttttatatggatggtggcgattgatatgtgggtttttttttttttttgttaaatttatttttggtagttattttaatacgttatttaaacgtttatttttattttttattttaattaggtagaattatgtagaaaggtgttatttttgtatagtatatttattttgagtttaatttgtgttttaaagtaatattttttttaaattttttagatttatagacgcgtttttttggtgtatttgtagttgtttggtttgagtaagagtggttttaggggggttttttatgtgggttttttgatagattgaatttttttttgaggttttttgagttttttgtgaggtggtgggtttgaaggtttttgttattttttaggggtttttgtttttagtttttagtttgtcgatgtttatttttgtattaataattttggtttttatttgttttgttttttttcgtttttaatatattatttaagtttagtgtttatggttaaggtagtttgattttttttttttttatgagttgtaatgtgttttaggaatgattagatattttttagtggatttttagtatttagtataagggagggcgatatttatcgagtggatatttaagtgttaggtgtattttcgttattttattttataatatgtttgttattttggtgttttcggggtatatttaagttagtacgtggtatatagtgtttatttggtaggtattttttaagttttaagtattttgttaggttttaaggatatagaatttatttttgggaatttttagtttggttaaacgggaaatgattggtaaataaatattatcgtaagagaggatggatgttatttgatggagttgtgttttaggtattgtgtgtttaggagttcgagatgatttagttaagggtggaagtttgattaggagtcgttaatttatagaagtggagtagaaagatgagaatagggaagtagatagggtttataatttgaagagttttgttgtttattaaggaatttagaatttattttgaatatataaggtagtttgttatgaagtttttatttttggtgtaggagtttttattttagggtttgtgggatggtaggtagaaggtaagaggtttatgagtttagataagaaaaaattgatatttttatttttattaatttttagataaaattattttttttaattataaatgtaagtagtaaagtaaaggtatattagtagtttttattttttttttattagtgataattatagatatttttatattattttatagttggaagttttttaaaatataatttatttttattgttataaaaattatagttattagaggttgtattagattttgttatttaatgtttaaaagtttacgggttattgtatttaaattattttttaaatgttttgataattattttagtgtttttttttcgagtttttttgtttgttttgttttttgagatggggttttattatgttgtttaggttggttttaaatttttgagtttaagcgatttatgtatttcggttttataaagtgttagggttataggtatgagttatcgtgattggttatttgcgagtttttttattacgtatttttaaatgttattttgagaaagggatatttaggcgttttaataggtgggtagagtatcgtgttttggtggaaagataaataaaatttaagtttagattgtgttgaggttagaataatatcgttgtggaggaagttagaggaggtttagttgtgggggaggtcggatggaggaaattgaatttgattaagtttagtattttggggtcgggtttggtggcgtatgtttgtaattttagtattttgggaggttggggtgggtagattatttaagtttagtagtttgagattagtttggttaatatggtgaaatttgtttttataaaaaaatgtaatgattagcgggtcgtggtggtgcgtgtttgttaaggtttagttatttcggaggttgaagttggaagattgtttgagtttgggaggtggaggttgtagtgagttgagatagtgttattgtattttagtttgggcgatagatttagatttagatttagattttgtttgaaaaaaaaaatagtaataataatattttgggtttttttttggtatatttgatagtgaaagaaattttttattattaaaagtaattgtgatttttatgtaatggtgattaagggtggatttagagttttaatttagaatttaaagttggtttggtagattgagttggtgaaggttaaaaagaaagaagtttttttatttgtttgaatttaaatatttttttttatatttatatgggagtattgttttttgagtatttgatatttgatattttagtttttatgtttggggtattttgggagggatgagttgggttttttagtattttggtgggaggaggatggcggtagatttttgagttgttttgttttgggagggtttgagtattcggaggtatgtagtgaggttagtttattttttttgtggtttaggtggataggtagtatggtttgttttgtatagaagggaatttagtttattagttgttggttgggtgaggattttggtatgttaggtgtttagtttttgtttgggtgtatagttaaagattttgtgttttgttttagttgtgtagttaataaatggagtcgatagttttgtgattttggtttggtgtttttttgttatattatttttagttttgagtttagggtaaagtattgttttggttaggggtgtttttgttgaggtttttgttttttaagtttgtgttgtgattgtattattgggtagtatttttagggtgtttagtattgtgtcggtggttgggggagatagtatttagattaaagggtagtaggtttggggtttttggtagagttaggaagaagtgttatagttattatttgtgttttttatataagggtaattggaatattgtataggaagggtagataaggggtagataagtaggtagagttaggtcgaggttattgtaaatattttatgatagttagatgtttagggatttgtattagtagtttaattgagatttggtggaacgtttgagagttggaatatgagtatgtttttagaaatgttatttgttgttttttttatagtaggaatttttttatttttttttttttgttttatttgatttggagttttaagtaaatattgcgtgttttttgtgatagatgttgttagagaatagtaagataggtttttatgaaataattattaaatgtatagtttttagtgaggggagttgtggaaggagtattgggagatttgagggagtgttttgaatagggttggagagtattttagatttaggggaaagttgatgttgaggagtttttgtgttgttatagttttagttgtgtattttaatatattatatttagaaagaggttatttatagtggagagagatagtggggtattttattattgtttttttagagtattttttttgttttcgtaattttattttaaaaatttagtatatttatttttaatgttgttttaatagttttattgtatttgtgtgatatttagttttatgttttataaaagtagatgtttgggattttttttattttagttagattatagttggtgtatttttaagtagttttttttgtcgggtagtggagtgtggtgggaggaattatagtgttaaattatttatttgttgtttttgtgatttttaattttttaggtaaggatttttagttttattgtttttatttgtgaatgaaagggttggtttttatttagaggtagattgtgggattatataggatggtttatgaaaggagtagggatttatattatatattgtgttttttttttttttttaatcgttgttatcgtttattttgtaaagttaggattgggtgtagtggtttatgtttgtaattttagtatttcgggaagtcgaggcgggcgggttacgaggttagaagttcgagattagtttggttaatatggtgaagttttattgttattaataatataaaaattagttaggtatgggtggtacgtgtttgtagttttagttatttaggaggtcgaggtaggagaatcgtttgaattcgggagatagaggttgtagtgagttgagatcgtattattgtatttagtgtaagattcggttttaaaaataaagttagatagtgttcgaggtttgggagtagaatttgattttgttataatgaaaggtttagtgggaagtaaattatttggagaggggaattgtgttttttgtggttagattttttaggttttacgtttgggaaattgcgttttagaaggttagtgagtagttgattttagttttaggtatgttgtttcgaattattcgttgttatagttgttttaaagatttttatttattttatttttatttgtgtggttgttgtaagtttgatatttttttttgatatattttttttgttttgtttattatttgggatttgttttttgttatttttaattgtagaggtatttaaagagtttttttttggggtatataggttttttgagtttaggtaagtttggagtagttgtttggttatttttagtagatgttgtaggattgtgattttgtataagtgttttttgtgtattttattaggttatgaggtagtttattattaaatgtagtagtgtgtggttaaaagggacgtggggtagagtttagtggtaaaaggttatttttttcgtggttgtgtttggtgttttaagagaatgagtttaagaatagtgggttatagttttttgatttttggggaagatcgtgagaaggatgttgtagttttttatgtgagagcggaggttgttttttttttatagataggagaataaaagttttatgtgttattttattgttggggttgggattggggtcgaggttaaggttaaggtttagtgggtttaagttaaaagttaattgtttatttatttttttttgttttttttttttttagt

SEQ ID NO: 2 - DNA, 10619 bp, Artificial Sequence
  chemically treated genomic DNA (Homo sapiens)
attagaaggaagagaaatagagggaagtaagtaagtagttaatttttgatttagatttattagattttgattttgatttcgattttagttttagttttagtagtgggatagtatatgaaatttttgtttttttatttgtgaaaggaggatagttttcgtttttatatgaagagttgtagtattttttttacgattttttttaagggttagaagattgtagtttattgtttttgagtttatttttttaggatattaaatatagttacgagaaaggtggttttttattattgagttttgttttacgttttttttgattatatattgttatatttagtggtgagttgttttatggtttagtgaaatgtatagaagatatttgtgtagagttataattttgtagtatttgttgggaatggttagataattgttttaggtttgtttggatttaaagggtttgtgtgttttagaaaagggttttttaagtgtttttgtagttaagaataataaggaataagttttagataatgagtaaagtagagaaagtgtgttagaaaaaagtgttaagtttgtagtagttatatagatgggagtggaatgaatggaggtttttgaggtaattgtgatagcggatggttcggggtagtatgtttagagttggagttagttgtttattggttttttggggcgtagttttttaggcgtaggatttgagaagtttggttatagggaatatagtttttttttttaggtggtttgttttttattaggttttttattgtgatagggttaggttttgtttttaggtttcgagtattgtttggttttgtttttgagatcgagttttgtattgagtgtagtggtgcgattttagtttattgtaatttttgtttttcgggtttaagcgatttttttgtttcggttttttgagtagttgggattataggtacgtgttatttatgtttggttaatttttgtattgttagtagtaatggggttttattatgttggttaggttggtttcgaatttttgatttcgtgattcgttcgtttcggtttttcgaagtgttgggattataggtatgaattattgtatttagttttggttttatagagtggacggtgatagcgattgggaagaaggggaagatatagtatgtagtgtgggtttttgttttttttataagttattttgtgtaattttataatttgtttttgggtgggaattagtttttttatttatagatggagatagtggggttggaaatttttgtttggggggttgggagttatagaggtagtaaatgaatgatttgatattatgattttttttattatattttattgttcggtaggaagagttatttaaaaatatattaattgtgatttgattaaagtaagggaagttttaaatatttgtttttatagaatataaagttaaatgttatatagatgtaataagattattaaaatagtattaaaagtaaatgtgttgaatttttaggatggagttgcggggatagggaaaatattttggaaaagtaatgataaggtattttattatttttttttattgtgagtggtttttttttggatgtgatgtattaaaatgtatagttaagattatggtagtataaggattttttaatattagtttttttttgggtttggaatgttttttagttttgtttagagtatttttttagattttttaatgttttttttatagttttttttattaagaattatgtatttggtgattattttataagggtttattttgttattttttagtaatatttgttatagagggtacgtagtgtttgtttagggttttaagttagatggaataaaaaaggaaggatggggaaatttttgttgtagaagagataataaatggtatttttgagagtatatttatgttttaatttttaaacgttttattagattttaattaggttgttgatatagatttttaagtatttggttattatggaatatttgtaatggtttcgatttggttttgtttgtttgtttattttttgtttattttttttgtgtaatgttttagttatttttgtataaagagtataggtaatggttatggtatttttttttggttttgttaggggttttagatttgttgttttttggtttgggtgttgttttttttaattatcggtatagtgttggatattttggaggtgttgtttaatggtgtaattatagtataagtttagaggataagagttttagtagaagtatttttgattaaagtaatgttttgttttaaatttaggattgagaatgatgtggtagaaaggtattaaattaaggttataagattatcgattttatttgttagttgtatagttgaggtaaggtatagaatttttggttgtgtatttaagtaaaaattgagtatttaatatattagggtttttatttaattagtagttggtgaattgggtttttttttgtgtagaataggttatgttatttgtttatttaggttatagagagaatgaattgattttattgtatgttttcgggtgtttaaatttttttaggatagagtaatttaaaggtttatcgttattttttttttattaaaatgttggagggtttagtttattttttttaagatgttttaggtatgagggttaaagtgttaggtattagatatttagagaataatatttttatgtaaatgtaaaagaaggtatttaaatttaagtaagtgaaaaggtttttttttttttggtttttattagtttagtttattagattaattttaaattttgaattaaaattttgaatttatttttaattattattatataaaaattatagttatttttaataataaagagttttttttattattaagtatattaaaggaaagtttagaatgttgttattattatttttttttttagatagggtttgggtttgggtttgggtttgtcgtttaggttggagtgtagtggtattattttagtttattgtaatttttattttttaggtttaagtaattttttagttttagttttcggagtagttgggttttaataggtacgtattattacgattcgttaattattgtatttttttgtagagataggttttattatgttggttaggttggttttaaattgttgagtttaagtaatttgtttattttagttttttaaagtgttgagattataagtatgcgttattaagttcggttttagaatgttaaatttgattaggtttagttttttttattcggttttttttatagttaagttttttttaattttttttatagcggtgttgttttagttttaatatagtttggatttgggttttgtttgtttttttattagaatacggtattttgtttatttgttaaggcgtttggatgttttttttttagaataatatttaaaaatgcgtaataaaaaggttcgtaaatggttagttacggtggtttatgtttgtaattttagtattttgtggggtcgaggtgtatggatcgtttgagtttaggagtttgagattagtttgggtaatatagtgagattttattttaaaaaataaaataaataaaaaggttcgaaaaggaaatattgagataattattaaaatatttgaaaggtaatttgggtatagtaattcgtgagtttttaagtattaaataataagatttagtatagtttttaataattgtgatttttgtagtaatgagagtaaattatattttgaaaaatttttaattgtaaagtgatatgaaaatatttgtaattattattggtgaaaaaaaaatagggattgttaatatgtttttgttttgttgtttatatttatgattagaggaaataattttatttagaggttagtggagatggagatattaatttttttttatttaaatttatggattttttgttttttatttattattttatagattttggggtaagagtttttgtattaggagtgagaattttataataggttgttttgtatatttaaagtaagttttaggttttttagtgggtaataaggttttttaaattgtaggttttgtttatttttttatttttatttttttgttttatttttgtgaattaacgatttttaattaagtttttatttttagttgggttatttcggatttttaggtatataatgtttagagtatagttttattaggtggtatttatttttttttacggtaatgtttgtttattagttatttttcgtttaattaaattggaaatttttaaaggtggattttgtgtttttaaaatttaatagagtgtttagaatttaaaaaatgtttattaaataagtattgtgtgttacgtattgatttaggtatgtttcgaggatattaagatgataggtatattgtgaaataagataacggaagtatatttggtatttgggtatttattcggtaaatgtcgtttttttttgtattaagtattgaaaatttattgagggatatttggttatttttaaaatatattatagtttatggaagggaggaaaattaagttattttgattatgagtattaagtttgggtaatatgttggaagcgaggaggaatagggtagatgagaattagaattattaatataaaggtagatatcggtaaattggaagttggaggtaggagtttttgggaaatgataggggtttttaagtttattattttatagaaggtttaggaaattttagaaggggatttaatttattaaaaagtttatatgagaaatttttttggagttatttttatttaaattagatagttgtaaatgtattaagagaacgcgtttgtgaatttggaaaatttggggaaaatgttattttaaagtataaattaggtttaaagtgaatgtattgtatagaaatgatatttttttgtatagttttgtttaattaaaataaaaaatgagagtgagcgtttaaatgacgtgttgaaatgattgttaaaaataggtttaataaaaaaagaaaaaaatttatatgttagtcgttattatttatgtagaataaaaattttttagaataagataggttaaaattagattagtttaaagagattatgtataatttttttttaatttttgaggcgaacggtagtaataaaatatcgttatttagaaaggagaagagaagaggtttttcgtttttataaagcgaaaggtaatattagttgtagattttatttttcgggttttttttgtaatattagtaaaatttttcggaagggtcggtcgggtcgttcgggaggaggggcggtcgcgggtttataggttttaagtgtcgtttcgagggttcgggttcgggttcgttcgttttttggggtcgtttttttttagttttttcggatatagttaattcggggcgtcgcgttttcgtttcgtcgttcgtatagggttcgtatttgtattatgatggttattcggagcgagtttttggggatgttttcgttgtattttttgtaagaggcgcgttcgtttttggcgtattcgattcgatagagtttattcgaagatttcgttatttttttttagttgtcgttaaagtttcggaagttcgacgttacgatttagaaatacgttgtcgtttcgtcgtttcgcgtgcgtttatttagtcgtagtttttgagcggttagagtcgttatcgaatacgtcgtatcggttatcgtcgttttttgatagattgttgatgtttggtcgcgggaacgtttacggaattcgcgtttacggggcggggtcggcggcgcgcgttttttgtcggtcggggggcggagtttttcgggcgtttgtcgggtggagttttgcggtcgttgtttgggggtcgaggcggggtttgggttgagttagtagttttttggaggattcggcgttatttttttgattgttttgttttaggaagttttatttgattttataattaattttatttttaattttttttttttttatttttgagattgagttttatcgcgttggagtgtagtgtcgttattatggtttattgtagtttggaatttttgagtttagcgatttttttattttagtttttcgagtagttgggattataggcgtttattataattggttaattaaaaaaaaattttttttagggatagggtttcgttaagttggttagattggttttaaatttttgttataagtgatttttacgttttagtttttcgaagtgttgggattaggggtatgtgttattacgtcggttttaaatttttaagtgtgtttttttttttttgagggtagttgggttcgggaagtcgggttttcgtttcgggaatatagttgattggttcgaggtggattttgtagtgttaggtttatttttttggtttggacgggcgttttaatttgtcgtttatagatcgtcgggataaaatattaattgaaatttagtattttttttattatgaatttgattataaatattaggagtattagtagtatttgtgattttgtgggtaatagttattatagacgtttttatgttattttatagttgttggtgataattcgaaatattattaagtttattattattcgaaattgtggtaatgatagtatttgttgttattagatattttgtgtgtgtgtgtgtgtgtgtgtgtgtgtgtaaagaaagagatggggaatttttttatgttgtttaggttggttttgaatttttggttttaagtaatttttttatttcgattttttaaattgttgggattataggtatgagttattgtatttggtttagattttgttgtttaatatagaattatattttaaaatatagtttattaaaattggttttttttttaattttatgtatttttttttttattttaaagattgtaatatgagtgtgttttatttgaaaatatttaattttggtatagaggataagaaaaataagtagatgaataaaatttataaaaagtgttaattatagagaagaagttagtggtttaagagataaggatgttgagtaagtaagaaggttgtgagatataggtcgaattttaaaagttagtaattagttagatacgttgaaggtaggttgggtatagtggtttatgtttataattttagtattttgggaggttgaggtggtcggattttttgagtttaggagtttaagattagtttggataatatggtaaaattttgtttttataaaaattagttgggggtggtggtaggtgtttgtagttttatttattcgggaggttgaggtgggaggattatttgagttttgaaggttgaggttgtggtgagttatgatagtgttattggattttagtttgggtgatagtgtgattttgttttaaaaaaaaaaaaaagatattttgaaggtaaatagaataagtggaaaatatgatggaataaataaaagttttatttagagaatgattaagttaaaaggtatgattatgttatttttgggttgataattatattatttttaaatggttatttattggtgataagattatggttttattttggtatttatatgttttgttttaaaaatgtagttaaagtttaggtttgtttagtaggttgattggtgagttgtagttgtggttgagtgtgtttgtatttgtgtttttttgatagtgtagtgtgagttgttttaggtattttttgttgagtcgttttgagtatttttaattttgttagtgggataggttgatgcggtagagagagggaaaatatattaatattagttaggtgtagtggtttatgtttgtaattttagcgttttgggaatttgaggcgggtggattatttaaggttaggagtttaaaattagtttggttaatatggtgaaatttcgtttttattaagaatataaaaattagttgggtattgtggtgcgtgtttgtaattttagttattcgggaggttgaggtatgagaatcgtttgaatttaggaggtggaagttgtagtgagtcgagattacgttattgtattttagtttgggtaatatagtgagatagttttaaaaaaagaaaagaagagaggggaggggaggattttttaattttaggttttggtggtgtggtttatttgtttcgtttgtattttattttgtgtatgttatgtattttatcgagtttttgttgtaagtggttttaaattgatttaataaatttgtaatttaagtattataatttggtttgtgaggttttttgttttgtaatttgtgggatagtttgtttgataatgtatttagaagttattattgtattaaggtaggtttttttataatatttattttggaaagggttttatggattattaaaggggttttaggtatatatataaaaggttaagaatttttgttttagaatttaaggaaagttaattattatttattgtttttttaatattttagtttggatggtttatatgtatttttatttatgtttaaaattgttttagtgttttttattttaggaaatggtttattattttttgtattatttaggttaaatgttttgtagttaatttgattttttttttttgttttatgtttaatttattttcgaattttaattttttgattttgatttttttttatggtttagttgttattttttttggtggttttgtattttttattagaatgtaagttttatgagggtaggagtttgtgtttgttttgttgtaatagttttagtgtttggaatagtgttaggtatttattaatatttgttgaatgaatgattgaattttatagttggtttttttttcgtataggttaatagtttaattaataatgttattttatatttgtatataattaatttatattgtgttttaaatttgaaatttttatgttgatttataatttttatagtatattaggtaaagttggtggttatataaaatattattaggatagggttgtttgaagaattatttgataatttttgttaataatataaaaatagaaaaagaacgttattatgtagtttataaataaattttaggtggttttatattttaatttttttttttaaaaggaatgagttgtgtttaggtaggttaaatgttttatagataagagaaaaaaaaaaaaagttgttatagaattattttatttgttattattatcgattttattttttattttttttattttttttgttttttttcgttttgttttttttttttgtttttttcggttttgatagtattatttttgttatattagtttttttttggttggatatgtagtattttgtttttggtattttttttttagttgagaagttttttttttgggttgtttgttatttgtagtatggttatttatgttttttttaggtttttggtattattgttagtggatagatcgggattttttttgatttgagggtagtatttagaatataaagtgaaagtttaaaggaggtttttcgggtgtattagaatttttgaatttttgttttattttttttttaggagggatattagtttttattttttttttataaagggttttgaatatttttggttatgtttttaatttttttttttttagtaagtaaggttttttatttttttgaatatgttaatgaatattttgagaagatgaatgaagtgtttggttgttttttttgtattttggtaagcgtgcgtagaatgttcgtgatgatattttgtttttgggattattgggttttttttcgtttatgtttagttatttttgtttagtgaggtatagaattatttagtgtttatttggtttttatttattttggtagtgtttttaggtaaggagttttagattagtttggataatatagtacgattttgtttttatatatataaaaaagtaaataaatttataataaatatttggtgtaaggtatgggtttagttatatttttttgtatgtggagatttattatttgtggaagagattgttttttttttattgaatgattttggtatttttgttgaaattatttaattatatatgttgagggtttatttttgggttttttattttgttttattggtttatatgtttgtttttattttaacgttatattatagtaagttttgaaattagaaagtgtgagatttttaattttatttttattttataaagttgatttgttttggtttggttttatattttgttaagattgattaggagtggaaagaagagatggtggttcgtgtttgtaattttagtattttgggaggttaaggtaggcggattataaggttaggagtttgagattagtttgattaatacggtgaaattttgtttttattaaaaatataaaataattagttgggtatggtggtgtatgtttataatttaagttatttaggaggttgaggtaggagaattttttgattttgggaggtagaggttgtagtgagtcgagattgtattattgtattttagtttggtcgatagattaagattttgtattaaaaagaaaaaaaagaaagaagagagatatataattttgattgttggtgtatgtgtgtgtggtggtggggtgggggggatgtttaaagttttatattagggattttttgttaagtaggtgaggt

SEQ ID NO: 3 - DNA, 6665 bp, Artificial Sequence
  chemically treated genomic DNA (Homo sapiens)
tttattttaatttatattgaattatattaattattttaatgggatttatataattttattttattaagttaatttttgagtgttaaaaatttaattttaatttattatttattgtgatatggagtttatgtttaatacgagatattttaaggtattgagtataataattatgagtaatttaattaagatataaaataaggtatagttatttttaaaaagttatttagttattttttaaaattatatggggtataatgtttaaatttgttggaattttaggtataagtataatttgagtatttattaagtttacgaggttttttaattggtgtattttggtaaatgttaaagttaatttagagtttttagttttggttaggcgtggtggtttacgtttgtaattttagtattttgggaggtcgagataggcggattatttgaggttaggagttcgagattagtttggcgaatatatagtgaaattttatttttattaaaaaatataaaaattagttggatgtggtggtgtgttttcgtagttttagttatttgggaagttgaggtaggagaattatttgaatttgggaggcgggggttgtagtgagttaagatggtattatcgtattttagtttgggtgatagagtaagattttatttttttttaaaaaaagtaaaaaatagaaaataaaaaattttatagttttaaatttaattacgattttagttatttttttgttatataaattttttggtatataaattttcgatttttaattgggtgaaattatggatgtttgttttaatttagatatacgtttgatatttttatttatgtatatgtataatttatttattatgtttatattaatttaaatgtttattaatgatagattagataaagaaaatgtggtatatatatattatgggttattatatagttataaaaaagaataagattatgttttttgtaggaatatggatggaattggaggttattatttttagtaaattaatttaagaatagaaaattaagtttagtatttttttattgataaatgggagttaaacgaaagaatttatgaatataaagaaggaaatagtagatattggggtttatttgagggggggagggtgggaggagggagaggagtagaaaagttaattattgggtatgggtttaatatttgggtgatgaaataatatgtataataaaattttatgatatatgtttatttgtgtaatgagtttttatatgcgtttttaaatttaaaataaaaattaataaaaattttatttatatataatttagttggttattttttttttttttttgtgttatagtttggatgtttggttttttttaaattttatgtcgaaatttgatttttagtgttggagagggagtttaatggaaggtgttggggttatgggggaggatgttttatgaatagattaatgtttttttttgggggtgagttttgattttattagtttttataagagttggttgttaaaaagattttggtatttttttttatttttgtttttttttttgttttgtgatttttgtatatattggtttttttttgttttttgttatgagtggaagtagtttgaggatataatcggatgtagatgtttaattttgaatttttttagatattagaattgtgagttaaatgtattttttttttttataaattatatagttttaggaattttttataatataaaatagatttaggtattttgaatttaggttttttttttttttattttttttttttatgttgttataagaaaaattgggattgtaatatatttttaaattgagaaggagttaagaaattaaagaatggtttagataaatttaggtttgtgagtagatgaatttattaggatttatatataaggtatttttggtgggagtaggatagttttagagatttgttttattatttagttttaagttttttttaagcgaatattttggttttttgtttattgtttgtaatgagattgttttttttggtatgtttttagagatattttgggatgtttgggttgttagggatattttttttttaggtaggtattatggtttttgtttagtgtttagtttttagggtgtaagtagtaaaaataaatttttaagtaatttggtcggggattcgttatattatattttttagttttaggttgttttagtttttatttttgattgataagaggaaagaatggaggagaaagggatatagtgttttttggtagtagtttttttttggataagtttttgtagtttatttttttttatttttttgttaaataaaatattttagagtggtttgtatttttaggttaaaatttttttttttttttttattttttttggttttttttgttttaattatttttttttttttttgtttttttggatatttatttgataatttaggtaaatatagagttaaggagttaagtaaattttaaataagataaatttaaagaaaattgtgttaagataaattttaattaaatatttgaaaattaaggatataaaatatatttaaagtagttagtgaaaatattttttttatagagaataataatttgaatgatagtggaattatggagaatagaagaaagtgttataatattttttaagtattgaataaaaagaatttttaatttagaattttatgtatagagaatgtattttttaggaatgaaaggaaaattaaggtatttttagatgaaggaaaaataagagaatttattgttattattaaaagatttattttaatagaatagttaaaagaagttatttaaatagggaggtaatgaaaaaaaaaaaaggagttatggaatattagaaaggaagaaagaatatagtaagtaaaaatatgggtaaatgtaatatgttttttttttttgtttgagttttttaaattatgtttgatagttggagtaaaaattataatattttttgatgtggttttatatgtttgtagaggaaatatttaatataattttattataaataaagaaaggtggttaaagagatatgattggaggtaaaatttttatattttattagaattagtaaaatgatgatattagtttattgtgaaaaattatgtatatataatgtaatatttatagtaattattataaaagttatataacgagatatattaaaaatataatagataatttagaattttgtttaatatttaatttataggaaggtagggaaaagaaaaaaatattaagaatatagagaagaaatagaaattaaaaaataaaatggtatatttaagtttaaatatattaataattatataatatataaagggtttaaatatattaattaaagaattatttggtagagtggattaaaaattatgatttagtgtatggtgtttataaggaatttattttaaatgtatgaaagttgaaaataaaatgatggaaaaaggtatattatgtagggttaggtatggtggtttatatttgtaattttagtattttgggaggttaaggtggtggattagttgaggttaagagtttaagattagattggttaatatggtgaaatttttttatttttattaaaaatataaaaattaggtggatttggtggtgggtgtttgtaattttagttatttgggaggttgaggtgggaggattatttgaatttgggatgttgagattgtagtgagttaagattgtgttattgtattttagtttgggtgatagagtaaggtttcgtttaaaaaaaaaaaaaaaaaaaaaaaaagatatattatgtaaataaaagagagtaggtgcggttatataaatattagataaagtaaagaaaattattagagacgtatagggatattatattaatgatgaaaagattagttaattaggaagatatggttatttatatgtatgtatattaaataatagagttgtaaaatatgtgatataaaaagtgatagtattgaaaggagaagtagattttataattgtagttagggacgttattatttttgtatttcgtagtataagtagattaaaaaatttataaggtagatttgagagtagtttgtataatatagtaagattttatttttaaaaaaaatttttgggggggtatgttggtgtatgtttgtagttttagttatttgagaggttgaagtgggaggtttgtttgagtttaggaaatgaggttgtagtgaattatgattatgttattgtattttagttttagtgatagagcgagatttcgttttaaagaaaatttgtaagggtatagaagaatttaatattattagttaatatgttatttaataatagtaaaatatatattttttttaaatgtttatggaatatatattaagatagattagaatttgagttataaaataaatttaaataaatgttaaagaattgaaattatatttagagtgtgttttatgattaaaatggaattaaattataaattaatggtagaaaggtaataggaaaatttttaaatatttagaaagttaaaacgtatttttaagtaatttataggataaagaggttgttttagggtaaattttaaaaatgtagtcgagtgaaaatgaaaatatattaaaattcgtgagatatagataatgagagtgaggagatttagtgatgagtaaaatttaagtgtatatattagtgtggtaggttaaattatggtttttttcgagtagcgcgttaggtcgttatttttcgcgggcggtgttgttaaggtaggttatttgcgcggggtagttagagtttttttatttgagcgggttgtggcggagagcggggtagggattggttggagtgtggtagtttagcggggcgggggcgggggcggggtcggtttttggtttttttttttttcgtaggtggttggaggtcgtagagtaatatagttcgtttatttttcgtcggtcgcgttttttttcggtttttttcgcgttatcggagttgcggcgttcgttaagaattatttggaggtattttttttgtttagcggcgattgcggtcgttttagggcgcggtttagaggaaattgggtgacggtggtgttcggtgtgtagtggggcgacgaaggtaaaggggaggtggcggatttattggcgtaggattttatgtgtcgttgttagggaggaaataatgttggttatatagttgttgtgtattttgtggagtatgatttttattttttatttagtggaataattattttaaatgttattgtatttaatggaaatggtgtggtaatttatttatttggattgtttgaagaagtagagaaaaatgtttaaaaaggaaaaggattagaaggttgggaaaaaggtttattttatttgatagagtttatattgtatttgatttttattaagtcgttgatggtgtttaggaataatagagataagaataagtaggaaaaaatttgggtataataaaaaagggtattggtttagtttatttttttaaagttgttcggagtggatttaggatgtgcgattttgtttttgattttgttggtttttttgagatgtttaaagttttagttaaataatataaatttatatattttattttggaaatagatattgaaggtgaattataaaattttaaggaaattggagaattattataaataaagggtagagagtttggtgtaattattggaaggaaaagaagatgtggttggttggatttcgttttgtttaaatatgtttatattattaatggatttattgcgttggaagttattaagttgaatattttggatatgtttatggaaattaaagttggagttgtttataagttagatggttaaattatattttatattttagtaaattaagaagttttaaagttgaagtttaatataagattttatgagaatggaatatagatatattaaatgtaagggtatttaaagaattatttgttaatgtataaaattatgttcgatttattgaagatgagttttaaattttagttaaatggattggtgttggtaaatttagagtttatgatttaatttttcgaatgattgatagtaaagtaagaaatattttttgagagggaggggaaaagatttttttaaatattttaattaagatttataaatttaagaataaataaattgaagtgagttttaggttttacggttgtttttagtttttttagatggatatttattgtggagattaattttggtatattttagtgttagttttttttagttggtataatttgttgtttttgttgtttttatggtgttatttttttttttaatgtttagtaataatataatttatgtttgaaatttaaagtagaattatttttaatgtagtttttttttattattgttattgtgtgtttttaagttttatttttattagatagtaagaataattaatgtagttttgtataaatatttttatattttgattatttaattttgtcgttgtaatttttgttgttagaaataaatgatgaaaatataggggttttgtaaatttttgtaatgttatgagttttgtttaaattgtggattgtttattttttgttgagattattgtaaaatttgaaagtcggtagttttaaagattggtggtagataagtttataaaaat

SEQ ID NO: 4 - DNA, 6665 bp, Artificial Sequence
  chemically treated genomic DNA (Homo sapiens)
atttttgtgggtttatttattattaatttttgaggttgtcgatttttaaattttgtaatggttttagtagaaaataaatagtttataatttaaatagaatttatagtattataaaagtttatagaatttttatgtttttattatttgtttttaataataaagattataacgatagaattgaatgattagaatgtaaaaatatttgtgtaaaattgtattaattgtttttattatttaataggggtaaaatttaagaatatataatgataataatgaagaaaaattatattaaaagtaattttattttagattttaaatatgaattatattattattaaatattaaaaaaaaaagtggtattatgagagtagtaggagtaataaattatgttagttaaggaaagttgatattggaatatgttaaagttaatttttataataggtatttatttgaaaagattggaaataatcgtagggtttaaaatttattttaatttatttatttttgaatttgtaggttttaattgaagtatttaagaaagttttttttttttttttttaaggagtgttttttgttttattgttaattattcgaagagttgaattatagattttggatttattaatattaatttatttaattggaatttgaagtttatttttaataaatcgaatatagttttgtgtattaataggtagttttttaaatgtttttgtatttgatatgtttgtgttttatttttatggagttttatattgaattttaattttaagattttttgatttgttggaatatgaggtatgatttgattatttaatttgtaagtaattttaattttgatttttataaatatgtttaaaatatttaatttggtaatttttagcgtagtaaatttattgataatatgagtatatttgagtaaaacgaggtttaattagttatatttttttttttttttaatagttatattaaattttttattttttgtttgtaataattttttaatttttttgagattttgtaatttatttttaatgtttatttttaaagtgggatgtatagatttgtattgtttagttggaattttaaatattttagagaagttaataaggttagaaataagatcgtatattttaagtttatttcgagtagttttggaagaataaattgggttaatgtttttttttgttgtatttaaatttttttttgtttgtttttgtttttgttgtttttggatattattagcggtttgatgaaaattaaatataatatgagttttgttagataaaataagttttttttttagttttttagttttttttttttttgaatatttttttttgtttttttaaataatttaggtagatgaattattatattatttttattgaatgtagtaatatttggaataattattttattgggtaagagatgaaaattatattttatagaatgtataataattgtatggttagtattattttttttttggtagcggtatatggggttttgcgttagtagattcgttattttttttttgttttcgtcgttttattgtatatcgagtattatcgttatttagttttttttgggtcgcgttttggggcggtcgtaatcgtcgttgggtagggaggatgtttttaggtagtttttggcgaacgtcgtagtttcggtgacgcgaggagagtcggaaggagacgcggtcggcgagaggtgagcgaattgtattgttttgcggtttttagttatttgcggaggaagagggagttagaggtcggtttcgttttcgttttcgtttcgttgggttgttatattttagttaatttttgtttcgtttttcgttataattcgtttaagtagggggattttgattgtttcgcgtaggtggtttgttttggtagtatcgttcgcgggaagtggcggtttggcgcgttattcggagaaggttataatttagtttattatattaatatgtgtatttaaattttatttattattgaatttttttatttttattatttatgttttacgaattttgatatgtttttatttttattcgattgtatttttaaaatttattttgagataatttttttgttttatggattatttagaagtacgttttaattttttaagtgtttggaaatttttttgttatttttttgttattgatttgtagtttggttttattttggttatagaatatattttgagtataattttaattttttaatatttgtttaggtttgttttatggtttaggttttggtttattttggtatatgttttataggtatttgagaagaatatatgttttgttgttgttgagtaatatgttgattggtggtgttaagtttttttatatttttgtagattttttttaagacggggtttcgttttgttattgaggttggagtgtagtggtatgattatagtttattgtaattttattttttggatttaagtaagttttttattttagttttttaagtagttagaattataggtatgtattaatatgtttttttagaaattttttttaagaatggggttttgttgtgttgtgtaggttgtttttaaatttgttttatagattttttggtttatttgtattacgaggtataagggtgatgacgtttttaattataattgtgaagtttatttttttttttagtgttattattttttgtgttatatattttgtagttttgttgtttgatatatatatatgtagatggttatatttttttggttaattgatttttttattattaatataatatttttatgcgtttttggtaattttttttattttatttgatatttgtatagtcgtatttgtttttttttgtttgtataatatgtttttttttttttttttttttttttttagacgaagttttgttttgttatttaggttggagtgtagtggtataattttggtttattgtagttttagtattttaggtttaagtgatttttttattttagttttttaagtagttgagattataggtatttattattaagtttatttaatttttgtatttttagtagagatgggggggttttattatgttggttagtttggttttgaatttttggttttaattgatttattattttggttttttagagtgttggaattataggtgtgagttattatatttggttttatatgatatgtttttttttattattttatttttaatttttatatatttgaagtgagttttttatagatattatatattgggttataatttttaatttattttgttaaatggttttttaattggtatatttagattttttatatattatataattattgatatgtttgggtttaagtatgttattttattttttgatttttattttttttttgtgtttttaatattttttttttttttttgtttttttatgggttgaatattgggtagaattttgagttatttattatgtttttagtgtatttcgttgtatagtttttatagtaattgttgtaggtattatattatatatatataattttttatagtgaattggtgttattattttattagttttagtgaaatatagaaattttatttttagttatgtttttttaattatttttttttgtttataataaaattgtattaaatattttttttataaatatgtagaattatattagagaatgttataatttttattttaattgttaaatataatttagaagatttaagtagagagagaaagtatattgtatttatttatatttttatttattgtgttttttttttttttttgatgttttataatttttttttttttttttattgtttttttgtttagataattttttttagttgttttgttagagtaggttttttggtgatggtaatgaatttttttattttttttttatttgagaatgttttggttttttttttatttttaaagaatatattttttgtgtataggattttgagttgagagttttttttatttagtatttgaaaaatgttatgatatttttttttgttttttatgattttattgttatttaaattgttattttttataaagaaggtgtttttattggttgttttaaatatattttatgtttttagtttttagatatttaattaaaatttgttttggtataattttttttgagtttattttgtttgggatttgtttagttttttgattttgtgtttatttgagttattaggtaaatatttaagagaataaaaaaggaaaaaaatgattgggataaaggagattaaaaggagtgaaagagagaaggaaaattttaatttagagatataagttattttaaaatattttgtttaataaaaaagtgggagaaagtggattgtaggggtttgtttagggaaaggttattgttaagaagtattgtgttttttttttttttattttttttttttattagttagagatagaaattaaaatagtttaaaattggggggtgtagtgtgacggattttcgattaggttatttaagggtttatttttgttgtttgtattttgaaggttgagtattgagtaaaggttatgatgtttatttgaggagaaggtgtttttgataatttaaatattttagaatgtttttgggaatatattaaggaaaatagttttattgtaaatagtaggtaaagagttagaatattcgtttaaaagaagtttagggttgggtgatggggtaggtttttggagttattttgtttttattaggaatattttgtatgtaagttttgataaatttatttatttataaatttagatttgtttgagttattttttggttttttggtttttttttagtttgggagtatgttgtagttttagttttttttgtaatagtatgagggagaggaatagaaaaaaaaaaaatttgaatttagggtgtttaagtttattttgtgttataaggaatttttgaggttgtgtaatttgtaaagaaaaaggatgtatttggtttataattttgatgtttaggaaagtttaagattgggtatttgtattcggttatgtttttaggttgtttttatttatggtaggaggtaaagagaagttagtgtgtgtagagattataaggtaagagaggaaataagagtagagagaggtgttagggtttttttaataattaatttttatgggaattaataaagttagaatttatttttaagaaagggtattaatttatttatgagatatttttttttatgattttaatattttttattgggttttttttttaatattgaggattaaatttcgatatggggtttggaggggattaaatatttaaattatagtatagggagagaaaaaaaataattaattgaattatatgtagataaaatttttgttaatttttattttaggtttgggggcgtatgtgaaggtttattatataggtaaatatgtgttatggggttttgttatatatattattttattatttaggtattaagtttatatttaatagttaatttttttgtttttttttttttttttatttttttttttttaaatagattttagtgtttgttgtttttttttttgtgtttataagttttttcgtttagtttttatttattagtgagaagatgttggatttggttttttgtttttaagttagtttgttaagggtaatggtttttagttttatttatgtttttgtaaaagatatgattttgtttttttttatggttgtgtagtagtttatggtgtatatgtattatattttttttatttaatttgttattgatgagtatttaggttaatatagatataatgaatagattgtatatgtatatagataaagatattaaacgtatatttaaattaaaataaatatttataattttatttaattggaaatcgaaaatttgtatattaaagaatttatataataaaaagatagttaaggtcgtgattgggtttagaattgtaaggttttttgttttttgttttttgttttttttagagagagataaagttttgttttgttatttaggttggagtgcggtggtgttattttggtttattgtaattttcgttttttaggtttaagtgatttttttgttttagttttttaagtagttgggattacgggagtatattattatatttagttaatttttgtattttttagtagagatgaggttttattatatgttcgttaggttggtttcgaatttttggttttaagtgattcgtttgtttcggttttttaaagtgttgggattataggcgtgagttattacgtttggttagaattgaaagttttaaattaattttaatatttgttaaaatgtattaattgagaaatttcgtggatttaataaatatttaaattatatttatgtttgaggttttaataaatttaaatattgtattttatataattttaaaaggtagttaaatagttttttaaaaatagttatgttttattttatattttgattgaattgtttatagttgttgtatttagtgttttaaagtatttcgtattgaatatagattttatgttataataaataataaattaaaattaaatttttggtatttaaaaattggtttgataaaataggattatataaattttattaaaatagttaatatggtttaatgtaagttaaaatagg

SEQ ID NO: 5 - DNA, 7544 bp, Artificial Sequence
  chemically treated genomic DNA (Homo sapiens)
cggttttgattttttgattttgtgattcgtttgtttcggttttttaaagtgttgggattataggtgtgagttattacgtttggtttttttttttattttttttttttatttgatttttttttttttgttttttttatgatttttttttttttttttttttttttttgttttttttatttttttatttttttttttatagtggagtataaattttttaaatattttttttattattttatttttttttattgtttttttatttttttagtatataaattattataaagttaaaatttttgatgaattataaaaaaagttgtagaatattattatagaataatataatttgatttgtttttaaatgtttatattagttttatttatattttatatagtatattatttttttaaagatttgatttattttaggtgaagtaatgaaattttttttttcgtttagtatgttacggtatatataataattttgagtaaaaagagaaaatagagaaataaaattaatttttaaataagttttttaaaaatatttttttaaaattttaaataatgtaaaagtgaaataattatttagtaagaaagtttttttttttaaataagtaaggggagttaggtgtggtggtttatgtttgtaattttagtattttgggaggtcgagacgggtggattacgaagttaggagattgagattattttgtttaatatggtgaaattttatttttattaaaaataatataaaaaaattagtcgggtatggtggagggtgttcgtagttttagttatttgggaggttgaggtaggaaaatggcgtgaatttcggaggtagagtttgtagtaagtcgagatcgcgttattgtattttagtttaggtgataaagtgagattttattttaaaaaataaataaataaataaataaataaataagtaagggaaatatggtgtttttatttaaattttataaagtaatagttattttataaaatcggtagaaaaataattatattttgatcgtaaaggtagaagttatgtaacgtttatttttgtacgttagattttttttttttttttagtttttatatttaatatagtaagattttgtttatttttttagttttttttttaaattttaatattttttgttttatatatgggttttgtttgttggtgatgttttgttttttgatttgggtgttggttatatgggagtatttgttttgtgaaaatttattgagttgtaaatttgtggtttatgaatttttttatatgaatattatatttttagaaaaagggttgttttttttttttttattagttttgtttgtttagatatttatgttattgtaaatttttatttttttttttttttaattttttttggtagttttatatttaattttcgaatttgtttaaatgttatttagttgattttttttagttttttaatttaaggttaaatttagtgttattttttttgagttaatttgtttttgttttttattataaagtatagttgtttgtagaagattatgttttatttatttttatattttaagttttagtacgatgtttaatttttaagaaatatttaagaattgagttaaatattttttatgttttttaagtttttattttattattttattataggtgatatgggttttagttttattttagaattaaagaatgttataaaatacgaattttttagttttttatttttatttggtttttaatttaatttggggattttaagaatgaaatgttttttttttttttttttatttaaatttaattttttcgtttgtgttttggattattttttatataatttttttgagtttttttagttgttttttttttttttttagttttaattttttttttttagtatttaaaataaattaagttatttttatttttgagaatatttttttaatttatatatttttttttttaggttttttagtttcgtttataaggaaatattattggggtatttacgtttttttgtgttatgaattattgtggtagtttagtgatgtttatagatttttttatagagtgtttttaaatgtatagaattataaagaaataattgaaaaatgtgtattaaatgttttaaaaaatgtgatatatatatttttttattagtgtattaaaaaaatataattaggtcgcgtatagtggtttatatttgtaattttaatattttaggaggttgagataggcggattatatgaggttaggagtttaagattagtttggttaataaggtaaaattcgatttttattgaaaatataaaaaatttagttgggtatggaaatatatatttgtaattttaattattcgggaggttgaggtataagaattttttgaattttgaaggtggaggttgtagtgagttaagattgtattattgtattttagtttgggtgatagaatgagattttattttaaaaagttaataaataaaaaagtttataattaagttaaagatttaataattaataaaattttgaagtaaggatgagtacgatgaaattttgagatgtttgtgattattgtattgtgataaggaaatattaatgatttttatagatgataaagttataggtattgttgatgttattagttgttgcgtatgtttataattgaagaaatgttaaattttagttgaaagttagtgaaaataaaggtataatattttttttatttagttttatgaaatttttgatttttattaaagggtttttaggttaagagtttttatattttagagttatttttatttttaatgttgggaaattttttttttttttagtatgttttttttggttttttggttttaaatatgatttatatgttgatgacgagtaaatgtatatatgtttgtttagttttttttttgaatattaggtttattttttttttttttttttttgagatagagtttcgttttgttgtttaggttggagtgtaatggcgaaatttaggtttattgtaatttttgcgtttcgggtttaagcgatttttttgttttttgattagttgggattataggtataagttattacgttcggttaatttttgtatttttaatagagacggggttttattaagttggttaggttggttttaaatttttgatttcgtgatttattcgttttggttttttaaagtgttgggattataggcgtgagtcgttacgttcggttttgaacgttagatttttatagcgaattgtttattttttatttttatttgtatgttattgttaataaaatatgtataaaatgtagtttttggtgtaggttttttttttagtatttttttaaatttggttttgtttgttttaattttaataaaaggtattattattatttaattgtttaagttaaaagtacgaattagttttgattttttcgttttattatttaatttatcggtaaattttgttagtttttttttaaattatttttttttatttttagtattattatattagtttaagttatttattttgtagttttgtttaatcggtatcgaaagaaagatatcggttttgggtaaatttcgatattagagttatattattatatttaataataatggttaatttaattttagaattttatagaggttatattttaatttagtaaaagatgaaatattttaaaataaaggattataggtttttattaaatggttttgtagaatagataaggaaacgtgggttagaaagttgtgattgtgtttaattttagaatagtgaagacgatttagattgtatttttaattgtatatgtgagaaaatttagtatatgtttttaatgttagttgaagttattttaatatagacgattttttaggtagtaatttttatttttagttgtttgttggagatttttatttaagagttttatatattttaaatttatatattagtttgaattttttattttttttttcgtatttttttttttaaagtaatgaatttatattatttattattagttaagtaggaaagttatttttttcgtattataaatttaattagttatattttgttttttaaatatttttggatcgtgtttttttttttttattggtattgtttttgacgtgagttagttttgattaattgataaattatttgtttttaggtttttagaaatggttttttttttggtaggtatttttattgtttgggttgagaattttcgggttttttttttttggtttgtatttcgtaaatcggttagagagggtttagttttcgggttattcgatttatattttggttggattagttaatattttttttatgtattcggttatagtgatgggattagtagattttattttgtatataagatgtcgtagtatcggcgttatcgggttttttgtaggtttattttcggagttgaagtatttttttttttaaataaaaggaatggttgcgaaaaatataaattaaatagattttatgataaatttgattatttacgagcgtaagtcgtttgagcgtttttaaaatagtttcgtgaatttttaatttcgttttatcgtagatcgcgggttattgtgtttagtacgtttacggggcgtagagatagtatttatttgtttacgattacgtagttttattgcgtttgtatcggattcgtttttagtttagggtatttttaaggtggaagtgagttttcgagtttttgatttttcggtatttttaattgaagagttgaggaaggcgttttacgcggtttttacggtaatcgggtttcgaggggattgacgtttatttgcgcgcgttacggtatataacggttttaaatttgattttagtagtatatttatgttgaaattcgtaggttagttcgtttcgttaggagttggggtttagattattttcgggagaagatacgtttcgataggaattacgttattggtagagcggaaataggttgagttttacgcgcgtatgttttgttcgttatggtcgtagttaaggagtttttggagttttatgttaagcggttttggcgtttcgaggaggtagtagaagattcggacgaggaggatgaggataatattagtgaagtcgagaatgggttttttttggaggaagtgttacggttcggaggtattaaggtaacggtcgcgggtttcggggaacgggattaggcgtggagagtttcgaaggtggttaggttgattgtttcgtcgttttcgcgttgcgtagagcgcgggcgtttaggatcgagattttagtttttgaagtatgtgttcggtgcgttttttacgtcggtttttattgttgtttataaaagaaaagtttcgaattgaacgttgtattttttggttatttttaggatgtaggcgattttttgattttattgacgtggtataattattatattattaggtcggagagtggttttttttggttttgattttgtggtatgagtgttttgaatattagtggtattggaatttttatttttgtttttatagagtatatgtacgtgttattgtatgttttagaagtttttttttttggagtattttaattaagggagagaaatagtaaataaatttttaaatatatagtatagtagacgcggggtagtgttataaaagaaaataaaataaggaaggacgataaggagtgggagcgcgttagtattaaatgagatgatcgataaatatattacggaaatgtttgagtagaattttaaaggataggaaggagtgagttgttattttagttagttggaatagtaaatgtaaagataggtagaagagtgtttaatttattttatgagtagttaaaatgttagtgtagtagaggtagagtgagttaaggggagaatagtaagaaaggagggtcgaggggttagagggtaggtttttgttttgagtttgatgtaaaattattggaagattttaagtagataaggaatagaaattaattttgtttttaatattattttgtttggagattggatttttaaggtggaggagttagttagagataggtagatttatagtttgttttgtgtttgtgtatatttaagttttgaataggtaatatatatatatgaaatacgtggtgtaaattttaaaagatatatagtgaagttaaattgtttttatttttattttagttataattattgttttgataggaagtaattatttttataattgtattttatattttttagggatattatatatttttttaagtatatatatatttatttatgtgtatgaaatacgggtgtattttttttatataaatggtattatatatatatatttatttttatattttgtttttttttttgttttagaaatttttttatattagtgtataacgttttgtgttattgttatggttgtataaattattttgtttgttttaatttatttaattagttatttattgtgaatatttaaattattgttagttttttattattttaaataatattatagttaataattttaatcgtgttttttttttatttttgtaagtgtatatgtagtataaatttgtagaaatgagttaggtatagtggtttatatttataattttagtattttgggagttagaggtgggaggatattttgagtttaggagtttgagattagtttgggtaatataaggagattttattttaaaaaaaaattttttttttaaatagttgggcgtgtagtgttagttataggttgaggttggaggattattttagtttgggaggttgaggttgtagtttagttatggttatgttattgtatttaagtttggataatagagcgagattatgttttaattagttagttaatttttagaaatgaagttgttgggttaatagatgtgtgttttgtattaaatagttgtgattggagttgataaattgttttttatggaggttgtgttagtttatatttatattaattatgtatgaaagtgtcgttttcgttattttttttttagtattatttgttattgtattttgtttattttgtagtgtatttttgtttatttgataaattaaaagatggatgtattattgtggttttaatgtggatttgtttaaattttagtgaggttgaatatttttttatatttttaaagaattttttttttttatgaattgtttatgttttttgtatattttttttttgggttgttatttattgatgtgtagaaatttatattaagggattaaatttaattattttgataggaattgtttgtattttttttttagtttataatttatattttttttttatatcgaaataaaaagtgtgtgtgcgtgtgtgtgtgtgtaaaagaaagagagagaaagagaaatttatttatttttttttttgtggattttgagttttatgttaaatttgaaaggatttttttagtttcgaaattatttttaaaattatgttgtgttttttattattttatggttttattttttatatttgtaatgtatttttaatttatgtttttaatgtagt

SEQ ID NO: 6 - DNA, 7544 bp, Artificial Sequence
  chemically treated genomic DNA (Homo sapiens)
gttgtattaaaaatataagttaaaaatatattataaatgtgaaaaataaaattataaaataataggaaatataatataattttaaaaataatttcggaattggaaaaatttttttaaatttgatataaaatttagggtttataaaggaaaggataagtaaattttttttttttttttttttttttatatatatatatacgtatatatattttttatttcgatataggaaaaaaatataaattataaattggaaaaaaaatataagtaatttttattaaagtaattgggtttaattttttaatataagtttttatatattagtaagtgataatttaaaagaaaaatgtgtaaaggatatgaatagtttatagaaaaaaagggttttttaagaatatgaaaagatgtttaattttattgaggtttagataaatttatattaaaattataatgatatatttattttttaatttattagatgagtaaagatatattgtaagatgagtaagatataatgataggtgatgttggggaaggggtggcggaaacggtatttttatatatggttgatgtgagtgtaaattgatataatttttatggaggataatttgttaattttaattataattatttaatataaggtatatatttgttggtttagtagttttatttttaaaaattaattaattgattgagatatggtttcgttttgttgtttaggtttgagtatagtggtatgattatggttgaattgtagttttaattttttaggttgaagtgattttttaattttagtttgtagttggtattatacgtttagttatttaaaaaaaaaatttttttttgagatgaggtttttttatgttgtttaggttggttttaaatttttggatttaaggtatttttttatttttgatttttaaagtgttgggattatgggtgtgagttattgtgtttggtttatttttataaatttatattatatatatatttataaaagtgggggaaaaatacgattaaggttattaattgtagtattatttaaaatagtgaaagattggtaataatttaaatatttataataaatggttggttagataaattaagatagataaaatgatttatgtagttatagtaatgatatagaacgttatgtattgatatagaaggatttttaagatagaaaagaaagtaaaatgtagagataggtgtatatatatggtattatttatgtaaaaaagatatattcgtattttatatatataaatgagtatgtatatgtttgaaaaggtatatagtatttttgaaagatataaaatgtagttgtaaaaataattgttttttattagggtaatggttatggttgagataaaagtggaaataatttgattttattatgtattttttaaagtttgtattacgtgttttatgtgtatatattatttatttaaaatttaaatatatataagtatagagtaaattgtgaatttgtttatttttaattaatttttttattttgaaagtttagtttttaaataaaataatattaaaaataaagttaatttttgttttttatttgtttaaaattttttagtggttttgtattaaatttagagtaaaagtttgttttttgatttttcggttttttttttttattattttttttttaatttattttgtttttgttatattggtattttggttgtttatggaataggttaggtatttttttgtttgtttttgtatttgttgttttaattgattggaatggtagtttatttttttttgttttttaggattttgtttaaatattttcgtgatgtgtttgtcgattattttatttaatattaacgcgtttttattttttatcgtttttttttgttttatttttttttatagtattatttcgcgtttgttgtattatgtgtttaaaagtttgtttattgttttttttttttaattaggatgttttaaaaaagagggtttttggggtatatagtgatacgtgtatgtattttatgagaatagaaatgaaaattttaatattattggtgtttaaaatatttatattataaggttaggattaagaaaagttatttttcgatttgatggtgtgatggttatattacgttaataaaattagaagatcgtttatattttaagaatagttagagaatataacgtttaattcgaaattttttttttgtaaatagtagtggaaatcggcgtgggaagcgtatcgaatatatgttttagaggttgggatttcggttttggacgttcgcgttttacgtagcgcggaagcggcggggtagttagtttagttattttcggaattttttacgtttgatttcgtttttcggagttcgcggtcgttattttggtgttttcgagtcgtaatattttttttagggagaatttattttcggttttattagtattatttttatttttttcgttcggattttttattgttttttcggggcgttaaggtcgtttggtatggaattttaaaggttttttgattgcggttatggcgggtaaagtatacgcgcgtgaaatttagtttattttcgttttgttagtggcgtaatttttgtcggggcgtgttttttttcggaaatggtttaagttttagtttttggcggagcgagttagtttgcgaattttagtatgagtgtattgttgaggttaggtttggggtcgttgtgtgtcgtggcgcgcgtaggtaagcgttagttttttcgaagttcggttgtcgtggaagtcgcgtggggcgttttttttagttttttagttgagggtatcgggggattaagggttcgggggtttatttttattttgaaggtattttgggttggaaacgggttcggtataaacgtaatagggttgcgtagtcgtgggtaagtgggtgttgtttttgcgtttcgtgggcgtgttaagtatagtagttcgcggtttgcggtggggcgaggttaagggtttacgaagttgttttgaaaacgtttaggcggtttgcgttcgtgaatggttagatttattatggggtttgtttaatttgtgtttttcgtagttattttttttatttggagagggaaatattttagtttcgggaatgagtttgtagaaaattcggtgacgtcgatgttgcggtattttatgtataaaataaagtttattggttttattattgtggtcgagtatatgaaggaggtgttgattaatttagttaaggtatgggtcgggtagttcgaggattaggttttttttagtcgatttgcgaggtgtaagttaggagggagaagttcgaaggtttttagtttaggtagtgggggtgtttgttaggggaagagttatttttgaggatttggggatagataatttgttagttggttagggttggtttacgttagaggtagtgttagtaaagaggagaggatacggtttaagggtgtttaggagatagaatgtagttgattggatttatgatgcgggaaggatgatttttttatttggttgatggtgggtggtgtggatttattgttttgggagaaggaatacgggaggaaggatggagagtttaggttggtatatgaatttgaagtgtgtgggatttttaggtagaaatttttaataggtagttggaaataggaattattgtttggaaagtcgtttgtgttggaatggttttagttggtattggagatatgtgttgggtttttttatatgtgtagttgagaatgtagtttgggtcgtttttattgttttaggattaggtatagttatagttttttgatttacgtttttttgtttgttttatagagttatttggtgaaagtttatagttttttattttagaatattttattttttgttgggttgaaatatgatttttgtggaattttggggttagattggttattgttgttggatatggtagtgtgattttagtgtcgaggtttatttaaggtcggtatttttttttcgatgtcggttaggtagggttgtaagataggtggtttagattagtgtggtggtattagaaatagaagagggtgatttagaaagggattgataggatttgtcgatggattgagtgatggaacggaggaattaaggttgattcgtatttttagtttgagtagttgggtgatgatggtattttttattgagattaagatagataggattaggtttggaggagtattagggagagggtttatattaggagttgtattttatatatattttgttagtagtgatatgtaggtggagatagaaagtaggtaattcgttgtaagagtttggcgtttagggtcggacgtggcggtttacgtttgtaattttagtattttgggaggttaaggcgggtggattacgaggttaggagtttgagattagtttgattaatttggtgaaatttcgtttttattaaaaatataaaaattagtcgggcgtggtggtttgtgtttgtaattttagttagttaggaggtaggagaatcgtttgaattcgggacgtagaggttgtagtgagtttagatttcgttattgtattttagtttgggtaatagagcgagattttgttttaaaaaaaaaaaaaaaaaaagtgagtttggtgtttagaagaaagattgggtaggtatatatatatttgttcgttattagtatataggttatatttaaagttaaggaattagggagaatatattgagagaaaggaaggttttttagtattgagagtaggggtaattttaaaatgtagaggtttttaatttagggattttttaatagaaattaggggttttatgaagttggatggaaaaaatattatatttttatttttattaatttttaattgaaatttagtatttttttaattatgaatatacgtagtaattagtagtattagtaatatttgtgattttgttatttgtggaaattattggtatttttttattataatatagtgattataggtattttaggattttatcgtgtttatttttattttaaaattttgttaattattgggtttttggtttgattatgggtttttttgtttgttggttttttgagatagagttttattttgttatttaggttggagtgtagtagtgtaattttggtttattgtaatttttatttttaaggtttaaaggatttttgtgttttagtttttcgagtagttgggattataggtgtatgtttttatgtttagttaggttttttgtatttttaatggagatcgggttttgttttgttggttaggttggttttgaatttttggttttatatgattcgtttgttttagttttttaaagtgttgggattataggtgtgagttattgtgcgcggtttaattatatttttttaatatattagtaaagaagtgtatatattatattttttagaatatttgatatatattttttagttatttttttgtggttttgtgtatttaaaaatattttgtgaaggggtttataggtattattgggttattatagtggtttataatataaaaaagcgtaaatattttaataatgtttttttatgaacggaattagaaagtttagaagaagagatgtgtggattgaaaaaatgtttttaaaaatgggagtgatttgatttattttgaatgttgaagggggaaagttgaagttggaagagagaaggggatagttaaaaggatttaggggagttgtatgaggaatggtttagagtataggcggagggattaggtttggatgagaggagaaggggaaggtattttatttttggagtttttagattaggttagaggttaggtggggatgggaagttgaggaattcgtattttataatattttttaattttggagtgagattggggtttatgttatttgtagtaaggtggtagaataggagtttgagaagtataagaaatatttaatttaatttttgagtgttttttgaaggttaggtatcgtgttaaaatttgggatatgaagataaataaggtatgattttttgtaaataattatattttgtggtgaagaatagagataaattagtttagaaaaggtggtattggatttggttttaggttggagggttggaggaggttagttaggtggtatttgagtagattcggaggttgagtataagattgttagggaaagttgaaaagggagaagggtgaggatttgtagtggtatggatgtttggataagtaaggttaataagaaaaaaaaaaataattttttttttggagatataatatttatatagaaaagtttataaattataagtttatagtttaatgaatttttataaagtaaatgtttttatgtaattagtatttaaattaagaaatagaatattattagtaggtagggtttatatgtgaggtagaaagtgttagaatttggagaggaggttggaggagtaggtagggttttgttgtgttgggtgtgggagttgggaggggaggaagggtttggcgtgtagagatggacgttatatgatttttgtttttacggttaaggtgtaattgtttttttatcggttttgtaaaatgattgttattttgtaaaatttgggtaaagatattatattttttttgtttatttatttatttatttatttatttattttttgagatggagttttattttgttatttaggttggagtgtagtggcgcgatttcggtttattgtaagttttgttttcgaggtttacgttatttttttgttttagttttttaaatagttgggattacgggtattttttattatgttcggttaatttttttgtattgtttttagtagagatggggttttattatgttaggtaggatggttttaattttttgatttcgtgatttattcgtttcggttttttaaagtgttgggattataggtatgagttattatatttggttttttttgtttatttagaggagagaatttttttattaaataattattttatttttatattatttaagattttggaggggtatttttaaaaggtttatttgaaaattaattttgtttttttattttttttttttatttagggttattatgtgtatcgtgatatgttaggcgaaaaaggagattttattattttatttgaaataagttaaatttttggggaggtaatatattatgtaaagtatgaatgaagttaatataaatatttgagagtagattaaattgtattattttgtagtagtgttttatagttttttttgtgatttattaaaagttttaattttatagtagtttatgtattgagggaatagagaggtagtagaggggagtaaaatggtagagagaatatttgaaaagtttatattttattgtaggaagggaaatggagagataagagggataaagagaaagagaaggaaaggagggggttataaagaggatagaaaaaggagaattagatgaaggaagagaatggaagaaggggttaggcgtagtggtttatatttgtaattttagtattttgggaggtcgaggtaggcggattataaggttaggagattaagatcg

SEQ ID NO: 7 - DNA, 7148 bp, Artificial Sequence
  chemically treated genomic DNA (Homo sapiens)
ggttgtttagtaggatttattaaatttagttttttttttttattataatagtttttttttttgtatttagatgttagttttttttattatttagttattaggaggagagtgttgatatgtttggttaggtgatgcgtttatgttttatattttgaattagagtagatttttaattcgggtttggttttttttagtttggttgatttcggataacgtttttttttgtttatatgggtataatatttattatatatgacgtcgtggggattgaatattatgagtaatgtttatgtgcggcgtttggtataaggtaaagttttagtatttttagttgttattgttttttttattttattttcggggattaaggtttaggggagcgtggatattaggtaaaagttttagatcgtataggtagtatttgggttttaatatttttattattttgtttttttttgtttttttttttttttttttaagtttggaattttttaaaaaggaagaaagatttttgtaatttgagaagtatatttgtgtttttatatattttgaatttttttagagaggttgtttaggatagatgattttagagttggattttttggagttggattttcggtttataggagataattttttaatttagatatattgttattttttattaatatttttcgtttatatatttagagattattatttgaaattaggatgtagatgagttttagtttatttagtagtattttttttttgtttttttaaataatcgattattaattataatgatgtttttttttttttagagggaatttttaatttttttttcgtgaaatggagtggttagaatgatttttattgatagaagaggaaattgaggtttagtgaggggtatgaatgttttttttgagttttagggtattgggtaggagataggttttattacgggtttttttggataggggatttagggttaggttgggagaaatttttagttttagaagagagttttttgtttttttcgttggattaggtttttgtgtgattcgggatatggggaatagaggttttttgggaaggaaacggggtttttggtagtgttcgttgaggtttagttgttatttaggaaagggtttgtttataggagggcggtcggttgggggcgaaagtgaggttttgagaggaatggttagataggtaattatcgagatttagttttggtcgttttgtgatggttgttggaaatttcgttatgagttgattttacgtggaggtaggttatagttagtttttattttttttaggtagtttgtgggcgaattgagggattaggatagtatggattggtttggagttttagtaagttttgaatatgagaattggatattttatagatggaagtgtgaggtttagagagaggaggggtgggttaaaggtttttagtaaggattgagaggttttatttttttatgatagtgatggttttcggaggttggagtattttttatgtgttaggtttgtgttaagtattttatatataattttatgaagggttattatgagtgttttattttataaatgaaagaaatgaggtttagagaggtttaggtaattttttttagagcgttgtgggtgagggaaaaagatacgtttaggtagagggattgtggattttagttttttttatagtttatggattttttaggcggttttttagggtatatttgttttttgtttggtatatttggggatttttgtttaggcgttatagagtttatatgaattatatttgttttgggaaggcggtatttttattgttaagaacgtatttagagagtatttttaaatgttagagggagacgaattttttttttggggtaaaggagttggttttatttgttcggggatgggttttgggtttatttagttttaagttaaggtagggtaggggagtgttttgattttttgttttttagttttgttgtggataatttagggtgtttttaggtgggggttattggggagaaattggtttgtttgtttatcgatttgatggaagagggagaaaagacgacggtttatgttaattggggaagggcgagggtgtttgtatgttttaggtgggggagtcggagtttttttttttattaaatagacgataatttttgtcggttcgggatggggaggaagtaggtggaaattgggaataagttagtttgttttgtgggtttttttcgggtgtttgaaaacgcgaagatagaaggcgtttattttattagaggtgaggaaggcggttttggtttgatataaagttatcggtttgtttgagatttggtcgtatggatggtaaggaaagggtagtttttcgggggcggtcgtcgcgtttgtattcggggtcgtagttggcgcgtatttgtagttcggtcgggttcgtattttcgcggttggtagggcgcgggcgttaattagcggcggttttcgttattgtgtttgttaggcggtttcgcgattttggtttggggatttaagggtttgtattcgtttttttttttttcgtcgttttggttttttggatttggtgtttacggggagttagcgttttacggagagtcggagtcgtgtcgggttttgcgttaggtgttagggtttataagagttttttattttttggaaatttgtttgtgaatttatcgtaagcggagagggagaaattaggcggaggaataagtaaagggtacggtgtaaatcgaaattattcgataaatggaatttattattatttgaaatagcgggttatggtttcgtaatttgttcgagggtagtacgtgttgttcgttttcggttagggttttatttggttacgacgcgttgcgttttttcggagacgttttcggaggtgggagcgtttaggttggattattcgtttttttttagttttgttgttcgtgttagcgcgttcgagggcgcgcgggtttgggttcgtaatcgataattgttaggcgtaggtttttttaaaaggtttagtaagggatttttgtcgttttttttttcgatacggtttgagggcgtgttgtgaggtttcgaggtgggtaggggttagttttttcggtggtcggggtgagtttagagtttttcgtttttggagcgtacgcggggtttgatttcgtttggtaacgacgaaatggcgcgcgttgagtaggggttagatttatgatgagattttgcggttatcgtcggattttaagtttttttgttttcgaggtttggaatttattgttttgtatttgtcgagagtcggaggtaacgaaaatttagtttcgtttttaaagcggcggggaggtttagtacgcgttcgttttttagagtttagggaggtgtttggggcgataattcggaatgattgtggtttgatttttttcgttgtttttttaattgtagtcggtttttaggtttgttcgatagatttaggaggcgggagaggaaggggtgatttgtagtgaagtttaggagaggttgggttacgcggttgggagtgggagcggggattcggagtcgggcgggtaggtagtgttttggcgaagttgttcgcggtttttgcggcgtagtcggagcgtacgggtttaagaagaagtggggttggattcgtagaggttattttttattcgtatggagaaagaaaatttttttttttgaaagcgagggtttttagttttgtagttattgttgttttttttttgttatcgacgcgcgtatcgttttacgatgtaggatcgtggttatatgcgtaaaggaaaaaaagaaaaacgtattttgtaggtttcgtcgtgttttttaaagagttataggtcgttataacgaagaacgacgtcgcgaggtttgtaagattttgaaatttgttttgaggggagagtagagaggaaaggggttgttggttttaggttatttagggtttttaggagattttttttcgtttgttttcggtttggtataggggttatcgaggttgggattaaagtcgcgtagggttgggagtagtaaaggtcgtcggtcgggcgtggacgacgcgtaaaatttcgtgtggggtggaggtttttgggttagaataatgtgcgggacgagggaggtgagtaatttttttggggcggtttttagtgcggcgttatcggttttgagatttcgcggtttttagttcggggttgtagaagttataggttcgaagtagtaagagttggggaagttcggtcgcggttagcggggaggaggagcgaaggggttgcgttttagcgttagggagttacgattcgagagagggcggtaagggcgtttttcgtgggattcggacgttttaagtaaatttttagtatttgtttcgggtttttagagttttcgggggttttgggttgtggtattggggtttttttcgcggggtggcgtttttcgttttttttcgttgggcggttttcggtaggtttcgttttttttcgcgaacgttatcgaggtgttcgcgatgggggtttcgtcgattggttgtgcgacgcgtcgtttcgttagtttcgtttcgcgggtttcgggggtattaatttcgcgcgggcggtcgcggtttcgttatttgattttggaggatttgttttggggttgcggtcgcggagtcggggcggtcgcgggcgagtttcggggcgggaggcggcggtagcggtatagtttcgcgcgggtttcgtcgcggtttaggtagtcgggatagttacgaggggcggtcgtacgcggggtcgcgcgtcgaggatgcgggattagtcgggtaggttgcgggcggtcgtcgggttagcgaggtttcgtagcgggcgggttttggcgagtagtggtcgggcgtcgttttttgcgttttgaggttcgggtttcgtcgtttttgttttttcgtttttcgcggtagcggcggtcgaggaggcgttcgcgtcggtcgttttcgggggaagtcgcgtcgttttcgtttgttcggcgttttgacggtcgttgttatgcgtattttcgtagatttaagtattagtcgtcgttttatattttttttttcggtttttttttgcggcggcggcggcggtaagatgggcgagaatagcggcgcgttgagcgcgtaggcggtcgtggggttcggagggcgcgttcggttcgaggtgcgttcgatggtggacgtgttggcggattacgtaggcgagttcgtgcgtatcgatagttttaattttttttgtttcgtgttgttttcgtattggcgttgtaataagacgttgttcgtcgtttttaaggtgagtgcgggattcggggcgggagggcgtcggttttggggtttcgggcgtttgagttgcgggagttagagtttcgggagtagtggggatgggaggtgttcgagacgtcgcggcgatattcgggtattcggtttagtttggttgcgcgttcggtttcgggatttcggcgtttcgttttggatgcgttttgtaggaatgatttttaacggggttgtttcgttttatttgggttttggggcgttttgcgtagagacgttggtgcggaaatgggcggatggggttttgcgtttttttaattcggatcgtttagatatagttttgcgggtaacggagaagaggatttcgggataggggtaaggatatcgcgggtggggtgcgaacggtgaaagggtttatttttcgtttttagtattttttttttcgcgtcgtttcgtaaaagttttttgtttatattttcgggttttcgaaattttatcggacggcgttaggtcgggatcggggtattgttttttagacgtttgttcggggatattatgcgtttcgaatggcgagttgagattgggggatttttaattttggtagtttttagttatttagaggatttttttttttatgttagggagtaggcgattgttttatttttatttttttaagggggtagcgagatgaaacgaaaacgtttcggtttttttttaaattttttatagttgtcgtgagaaaagggtagggtaggaagggtcggcggttgggggtggtgttgttcgaggtggttggaagttgaggtcgtttttgtttttattaagacgattttaaatgggaaaaaaaggaagagtggttttttgaggtttttcgggtgatattttaaaatattagtgggggaaatttcgtcgggaggggcgggaggttcgtgtgattttaatcgttagatcggaggttttattgttatttggagtttaaaaggagtttttgaaattaaaagaagataggatgttgataggaaatttggtttttttaattagattttaaatattttttttttgaaatttttattatatggatttttagtttttgtacgcggcggttacgtttaaatagttgtgattttgtttaaagtttgatttttttttaaaaggtattcgttttttcgtgtttttgggggtgggggatttgggggagatggtgtttagggggatatcgttatttttattttgtaattttcggtaggtgtatttttttattattaaaagttttatttttattttaaaggggttttttggtggttttttttaaaatattagtgagttttgtattttgtattttttttgtataacgaatttaggttttgtagaggttaataaattgggtttggtttatattttagggttaaattttatgttttaaatagtttttgtataaattgagtgggggtagtagttttgttgttattattgttgttatttttttttatttggagatttcgttgttaggagtatgttgatttttttttcgttgtagtcgaagataataggggaattgtattttatattatagtgattgagttgatttatagttttggtttagattttattgaaaggatgattttttgggatatagtttatgtaagtagttgatttaggattttggtgtggaagttcgagattttatttttttgttttcgtgatatttgggggaaggtttttattgtttttaagttttttttttattttgtattggagaaatatttagtgtgtttgggatttgggggagttgtttagtttagtttttttttttttttttttggttattttttttttttttaagttgtttttttgtattttttcgtttcgtgtttttagg

SEQ ID NO: 8 - DNA, 7148 bp, Artificial Sequence
  chemically treated genomic DNA (Homo sapiens)
tttgaagatacggggcggggggatgtagggggatagtttagaaaggaagagggtgattagggaaaggaggggaggggttgggttgggtagtttttttaggttttaggtatattgagtatttttttaatgtagggtggagaagaggtttaaaaataataaagatttttttttaaatattacgaaaataagaagatggaatttcgagtttttatattaaaattttagattaattgtttatataaattgtgttttaagaaattatttttttaatgaaatttaagttagagttgtgaattagtttagttattatgatgtggggtgtagtttttttgttgttttcggttgtagcgaaagaggaattaatatgtttttagtaacgaagtttttaaatgagaaagagtaataataataataataatagggttgttatttttatttaatttatgtaagagttgtttagggtatgaaatttggttttgaaatgtggattaggtttagtttattggtttttgtagagtttaaattcgttatgtagagaaaatgtagaatgtaaaatttattggtgttttgaaaaaggttattagaaaatttttttaaagtgagagtggggtttttgataatggaaggatgtatttgtcgggaattgtaggatgggggtggcgatgtttttttaaatattattttttttaaattttttatttttaggagtacggagaggcggatgttttttgaaaaagaattagattttaaatagagttataattatttaaacgtggtcgtcgcgtgtagggattggggatttatatggtaaaaattttaaggagaaaatgtttgggatttgattaagaagattagattttttgttaatattttgtttttttttaattttaaagattttttttaagttttaagtgatagtaaaattttcgatttgacgattaaagttatacgggtttttcgtttttttcggcgagattttttttattggtattttaagatgttattcgggagattttaaagagttatttttttttttttttttatttagagtcgttttaatgggagtagggacggttttagtttttagttatttcgggtagtattatttttagtcgtcggttttttttgttttgttttttttttacggtagttgtgagaggtttaggggaaaatcgaggcgttttcgttttatttcgttgtttttttaaaaaaatgaaaatgaaatagtcgtttattttttggtataaagaaaaaggttttttaaatggttgggggttgttagggttaggggttttttaattttaattcgttattcgggacgtataatattttcgagtaaacgtttggagagtagtgtttcgatttcggtttagcgtcgttcggtaaaatttcggaagttcgagggtgtgagtaggaagtttttgcgaagcggcgcgggaggaggggtgttggaggcggagggtaggtttttttatcgttcgtattttattcgcggtgtttttgtttttgtttcgggattttttttttcgttattcgtagggttgtatttgagcgattcgggttaggggggcgtaaaattttattcgtttattttcgtattaacgtttttacgtaaggcgttttaaaatttaggtggagcggggtaatttcgttaaaagttatttttgtagggcgtatttaaaacggaacgtcgaggtttcggagtcgagcgcgtagttagattgaatcgggtgttcgggtgtcgtcgcggcgtttcgggtattttttatttttattgttttcgaggttttggttttcgtagtttagacgttcggagttttagggtcggcgttttttcgtttcgggtttcgtatttattttgaaggcgacgggtagcgttttgttgtagcgttagtgcgagggtagtacggagtagaggaagttggggttgtcggtgcgtacgagttcgtttgcgtggttcgttagtacgtttattatcgagcgtatttcgggtcgggcgcgtttttcgggttttacggtcgtttgcgcgtttagcgcgtcgttgttttcgtttattttgtcgtcgtcgtcgtcgtaggggaaggtcggggagggaggtgtgaagcggcggttggtgtttgggtttacgggaatacgtataatagcggtcgttagggcgtcgggtaggcggagacggcgcggtttttttcgggggcggtcggcgcgggcgttttttcggtcgtcgttgtcgcgagaagcgggaaagtagaagcggcggggttcgggttttagggcgtagggggcggcgttcggttattattcgttagggttcgttcgttgcgaggtttcgttggttcgacggtcgttcgtagtttgttcggttagtttcgtattttcggcgcgcggtttcgcgtgcggtcgtttttcgtggttgtttcggttgtttgggtcgcggcggggttcgcgcggggttgtgtcgttgtcgtcgtttttcgtttcgaagttcgttcgcggtcgtttcgatttcgcggtcgtagttttagaataaattttttagaattaagtggcggggtcgcggtcgttcgcgcggggttagtattttcggggttcgcggggcggggttggcggagcgacgcgtcgtatagttaatcggcggagtttttatcgcgggtatttcggtggcgttcgcggggaggaacggggtttgtcggaggtcgtttaacggggaggggcggaaggcgttatttcgcggaggaggttttagtgttatagtttagggttttcgagagttttgggagttcggggtaaatgttagaaatttgtttagaacgttcgggttttacggaaggcgtttttgtcgttttttttcgggtcgtagttttttgacgttggggcgtaattttttcgtttttttttttcgttggtcgcggtcgggtttttttagtttttgttgtttcgggtttgtgatttttgtaatttcgggttgggggtcgcggggttttagggtcggtgacgtcgtattgggagtcgttttaaagaggttatttatttttttcgtttcgtatattattttgatttaagagtttttattttatacgggattttgcgcgtcgtttacgttcggtcggcggtttttgttgtttttagttttgcgcggttttggttttagtttcggtggtttttgtgttaaatcggggataggcggaagggagttttttagggattttaagtagtttggggttaataattttttttttttttgttttttttttaaaataagttttaggattttgtaggtttcgcggcgtcgtttttcgttgtggcggtttgtggttttttgaaaaatacgacgaggtttgtaaaatgcgttttttttttttttttttacgtatgtaattacggttttgtatcgtgaaacggtacgcgcgtcggtggtaaaagaaaaatagtagtggttgtaaagttaagggttttcgtttttagaggagagaattttttttttttatgcgggtggaaagtggtttttgcgggtttaattttatttttttttgggttcgtgcgtttcggttgcgtcgtagggatcgcggatagtttcgttaaggtattgtttgttcgttcggtttcgggttttcgtttttatttttagtcgcgtggtttaattttttttgggttttattgtaaattatttttttttttttcgttttttaagtttgtcgagtagatttaggggtcggttatagttgggagggtaacgggaaagattaagttataattatttcgaattatcgttttagatatttttttagattttggggaacgaacgcgtgttgagttttttcgtcgttttggagacggggttagattttcgttgttttcggttttcgataggtgtaaaataatgaattttaagtttcggaagtaaagaagtttaggattcgacggtggtcgtaagattttattatggatttgatttttgtttagcgcgcgttatttcgtcgttgttaaacgaaattaagtttcgcgtgcgttttaggggcgaaggattttggatttatttcgattatcgggagagttggtttttatttatttcgggattttatagtacgtttttaggtcgtgtcgaaaggaaggacggtaaaggttttttattgaattttttaagagagtttgcgtttggtagttgtcgattgcggatttaggttcgcgcgttttcggacgcgttggtacgagtagtagaattagaggaaagcgagtgatttagtttgggcgtttttattttcgggaacgttttcgagaaggcgtagcgcgtcgtggttaggtagggttttggtcgggggcgggtaatacgtgttgttttcgagtaggttgcgggattatgattcgttgttttaggtggtggtaaattttatttgtcgaatggtttcggtttgtatcgtgttttttgtttgttttttcgtttgattttttttttttcgtttacgatgggtttatagataagtttttagagaatgagggatttttgtgggttttggtatttggcgtagggttcggtacggtttcggtttttcgtagggcgttggtttttcgtgggtattagatttaagggattagggcggcggggggagggggggcgggtgtaggtttttgggtttttagattaaggtcgcggggtcgtttggtaggtatagtggcgggagtcgtcgttagttggcgttcgcgttttgttagtcgcggaggtgcgggttcggtcgggttatagatgcgcgttagttgcggtttcgggtgtaggcgcggcgatcgttttcgaggagttgttttttttttgttatttatgcggttaggttttagataaatcgatggttttgtgttaaattaaggtcgttttttttatttttgataagatggacgttttttgttttcgcgtttttaggtattcggggaagatttatagaataggttagtttgtttttaatttttatttgttttttttttatttcggatcgataaaaattgtcgtttgtttgatgggagggagaatttcgatttttttatttggggtatgtagatattttcgtttttttttagttggtatggatcgtcgtttttttttttttttttattagatcgatggataaataggttagtttttttttagtggtttttatttaagagtattttaagttgtttatagtagggttaggaagtagaaggttaggatatttttttattttattttgatttagagttgggtaaatttagaatttattttcgggtaaatagagttagtttttttgttttaggaaggggattcgtttttttttggtatttaggagtgttttttaagtgcgtttttggtagtgagggtgtcgtttttttagggtaggtgtgatttatgtggattttgtggcgtttgggtagggatttttaggtatattagataaggggtaggtgtgttttgggaaatcgtttaagaggtttatgggttatggaaggagttggggtttatagtttttttgtttgagcgtgttttttttttttatttatagcgttttagggaaagttgtttaaatttttttgagttttattttttttatttgtaaagtggggtatttatagtggttttttatagaattgtgtgtaaagtgtttagtataggtttggtatatggagggtgttttagttttcgggagttattattgttatgaaaaaataagattttttaatttttgttgggggtttttgatttattttttttttttttgggttttatatttttatttgtgaaatgtttagtttttatatttaaagtttattaggattttaagttagtttatgttgttttgattttttaattcgtttataggttgtttgggggaggtaaggattggttgtgatttatttttacgtggagttagtttatagcggggtttttagtaattattatagggcggttagagttgggtttcgatgattgtttgtttgattattttttttagaattttattttcgtttttagtcggtcgtttttttgtgggtagatttttttttgagtagtaattgggttttagcggatattgttagggatttcgttttttttttaggaggtttttgttttttatatttcgaattatataggagtttagtttagcgaagagagtagaggatttttttttagaattgaaaattttttttagtttggttttaaattttttgtttagagggattcgtggtgaaatttattttttgtttagtgttttagaatttaaaggggatatttatgttttttattgagttttaatttttttttttgttaatggaggttattttaattattttattttacgggagggggattaaggattttttttaggaggggaggggtattattgtgattgatgatcgattgtttgaagaaatagaaagaaaatgttgttgagtaaattaggatttatttgtattttgattttagataatgatttttgaatatataagcgagaaatgttaatgaaaaatggtaatatatttgggttgaggggttgttttttgtaggtcgggggtttagttttagagagtttagttttggggttatttattttgggtagtttttttggaaggatttagaatgtgtgggagtataaatgtgttttttaaattatagagatttttttttttttttggaaagttttagatttggaggggagggagaaggagtaagggagagtagggtggtgagggtgttaggatttagatgttgtttgtgcggtttgagatttttgtttggtgtttacgtttttttgagttttggttttcgagggtaaaatgggaagaatagtaatagttgggggtgttgaggttttattttgtgttaggcgtcgtatatgggtattgtttatggtatttaatttttacggcgttatatgtggtaggtgttatgtttatgtaagtaaagaggaacgttgttcgaggttagttaggttagagagggttagattcgggttaaaagtttgttttggtttaaaatgtggggtatgaacgtattatttggttaagtatgttagtattttttttttagtggttgagtaatgggaagagttagtatttagatatagaggaaagagttattgtgatggggagagggagttgggtttggtaaattttgttaagtagtt

SEQ ID NO: 9 - DNA, 8543 bp, Artificial Sequence
  chemically treated genomic DNA (Homo sapiens)
ggaaggaaggaaggaagggaaaagaaaagaaaaagaaaaaaagaaatgagttgtttaatatttaaagttttgggggaaattagaattttaaaagtgtatttatggagagataaggagagtagggaagcgtatgttaagtttttatttattgagtaagtgtgttttgtatgttaggaattggttttggtataatattttttttaatttttttagtagttttttatattatttgttttttggggagataggataagtaattttatgggtagagttgggcgtttgtggataaaaaatattaggtcggatatagtggtttatatttgtaaattttagtattttggaaagtcgaggtgggaggattatttgagtttaggagttcgagattagtttgggttgcgtggtgaaattttatttatataaaaaattagttaggtatggtggtgtatgtttgtagttttagttatttaggaggtcgatgtgggaggattatttgagtttgggaggcggaggttgtattgagttgagatttaattattgttttttagtttgggtaatagagtgagattttgtttcgaaaaaaaaaagaagaaagaaaaagaaatattggattttgggttgattatgcgttgagtttatatgttttatatgttaagatttaaagtttaaaatgaattagtataaaatcgtttatgaatttatttgtaataaaaagtaattagtgtttttattttgttttgtttgtttagttggaggaaggtttttgagagtattttattgaatgattgagatattattagttatattatattagatatttgtatttttagttagagtttagttgagtttgaaattatagttttggatttttattttatttgaattggttttgtttggagcgattaattttatatatatattttagttttagataaagttagaaaattatattagaagggttagtttcgtttttgttttttagaatttgattgatttttaaatttacgtattaattttttcgtgggttttgtattaggaaggttaaattaaagtaaaataaaatatttttagggttttgtttgtttttttaaaatggttagtgttgtgattgattttagaattaggttttattttggagtatttaaaatttaggattatcgtttttcggggatttacgtttaattttttatattgggtttgtgtatatttttatttatagttttaggaagaaggattttaaaggtggttatagaagaatttataagttgtttttaggattggttttgttttagttgtatatgagttagagttattttttttaattaaaggtgattttttttttgtttttatttttttagttataagttaattgtttatgagattgttagatattagtttttttttttttattttgtgggatttttttatggaaagtgtttttatcgattttagggttttattttaattttttagttaattttttgttttagggtttgggtaggatatttttatttagggttttagatattttttgttttttgagaatttcgttaggtttagttagagatttattatttgtttttaaaattattttttttttatttcgaggtatatttttaggtttttaaggaaaaattagaatatggtagatggattttcgtaattgttttaaggtttttttttttaaaattataaagtaggtaggtgagtattttggaatgagtttttagtggttttttgggggtttggagaggggtttttaattttttgggtattatatgtgttagggggtggtaattttagttagaagtttggtatttagtttttaagttttgatattttgttttaatttattttgttcgtttattattggggtaatataagtttttatttttttttatttggttaatatttttttttcgttttggttagagtagatttttaggaatttaaattcgataacgaagtttttttgttaaaatttggaggttaaaagtttgggagataagggttttttttttatttgtagtggttttggttattagtttagttttgtttgcggatttagttttatttaggttttatttttttttattttattttttagtcggttaattatttcgttttttgttattagaatatatgtattggtaggttttttatttttgtatttattattttttttttttagaagagttttttttttttatttttttagtaaatttttgtttaatttttaaggtttagtttaaaggtttgtttttgtatgaagttttgttttatcgtcggtttagtttaagtaggttgttattatagatttattataaatatttattttttatggttttggaggttggatgtttaaggttaaagttaagttgttagtatttttaggttttggtgaggggttttttttttgtttgtagacggttattttttttttgtgtatgtttatgatattgtttttttgataaggttattaattttattaaattaggattttatttatatgatattattttattttaatgattttttaaaagttttatttttaaatatagttatatgggggttaggtttttaatataggaatttggggtagggatatagtttagtttataatattttcgtagataaatttgatttttgttttttttatagcgttattttgtttagggtaggatttttttttattatagtatatttatttttgatttttatttgtgtttcgtgtgtatttgatgaatgaatgaagttttattttttattttttttgttttttttttttttttagtagtttttgtgtgataatttattcgttttttttattgttttagtttttagaggtaggagttatttttttatgtatttttgggttttcggtattttgtatagggtaggttcgggtgggtgaattttggtttaattgtaggaggatttgtggtttttggggttggcgaatttcgggtcgggagttttattttttgttattgtcgtttttatatatttattagttttttattggataaagttttatttttattattgaggttttttttagttttacggggtagagttttcgatttttgggtaggtaatagtagttgtgtaaaaaaggttagatatcgttttttttttataattttataggtcgggaatcgtgtatgtatagtggcgtttttttgtttttaggtaggaaaagttattagttttagtatcgtagaaaaaaacgtaaatcgtttttggtgttttttgattttcgtttaggtttttttttataggtgaatgttatatgaatgggttttgtatttggtttagtaagtagtttttcggtttatatcgggatatttatttaacgtatttggtttttattttttttcgtttaaaagcgttaagttaaaaatattttgtttatgagttttggatcgaaaacgaagtagttgggttattaattattgggattatgttgaataggaatttgattaaagcgtagtgtgcgttgtttagatgaaattgtttttttattgcgatcgtcgtggaagttcggggttttttagcggtgtttttagttgtgtttttttcggggtttttgggcgggtcgtggcgttttgttaggtttaaggttattgtcggtgaagggggtttttttttatttgtaggtaagcgcgtttttagtcgggacgtaggcggcgttaggttttagcgttagtggcgaggggcggcgcgggtaaggataggagatatttgagggtttttaagattttatttgggtttagttgacggttcgtagtcgttatttcggtttcggtaaagaatgcgagggacgtacgtggttgggggtttcggtggtaagttttttttttcgtcgcggtgagagtattagttgtcgtatttaaggggttttagggtttggtcgtttcggtttttaggatttcggggattatagcgttcggcgaattattgggtagagttttttttgtgcgtgttcggatttggtagttcggcggtttggatattttcgttttcgtcgttggcgtttatttgaatggggaggcgggggaggaagcggtggtttcgggtttcgaggcgttgcggttttcgtttcggaatttcggttttagagttaagtttgttttttttttcggtgcgttttttttcgtgttcgtttcggcgtttagtttcgttagtttggggggtttcgcggtttcgtaggaaaaaaaatcggcgattttacgtcgggtaagtagcgtcggtttcgcgcgtttagtaagtcgcgcgtttcgatttggagaagtaattataaagaaagttttttagttcgggcggatcgatcggttaggttttttaggttttcgggtcgaggtcgttttcgtttttcgcggggttttagcgttttgcgcggcgtcgtttatgggatttcggcgtttttcgagaggtatttttgcgcggaattataggggtagtttggagattagagttaggagacgtagagttatcgcgtttaggattttttcgcgcgttttaaacggttttttatcggttttagtttcgttgttttgcgttgtagttttttcgggacgcgggttcgggataggtttggttttggttttgaaagagaattcgcgttttagtagtttaagattaagattcgtttttcgttttttatttttatttcgtgtagtttcgggatatttttgggttttcggtcgtggttggatacgggcgtttagggtaggtaggaggagggggttttcgttatcgattacgtgggcgcgggggcgacggtcgggtcgggggcggagtttggagcgagcgtcgcggttttgttgggcgcgttggaggcggtgggcgttgcgtcgcggtttgtttggggagcgcggcgttgtgtcgcgttggttcgtcgttttatgtcggtcgcgcgttaggatttagtaggcgtcgcgtcgtcgtagttcggggatagaggtcgtttcggattttagggggcgacgcggtttgtcgggtataaaagttgggtcggcgcgggtcgggttattcgcgattcggaggtgcgcgggcgcgggcgagtagggttttcgggtgggcggcggcgacgtttcgcgtaggttggaggtcgtcgaggttcgttatgtcgggagaattttaatttttttatggagtcggtcgatttttacgaggcggagtcgcggttttcgatgagtagttatttgtagagtttttcgtacgcgtttagtagcgtcgttttcggtttttttcggggcgcgggtttcgcgtagtttttcgttttatttgtcgtttcggagtcgttgggcggtatttgcgagtacgagacgtttatcgatattagcgtttatatcgattcggtcgtttttaacgacgagtttttggtcgatttgttttagtatagtcggtagtaggagaaggttaaggcggtcgtgggttttacgggcggcggcggcggcggcgattttgattattcgggcgcgttcgcgggtttcggcggcgtcgttatgttcgggggagcgtacgggttttcgttcggttacggttgcgcggtcgtcggttatttggacggtaggttggagtttttgtacgagcgcgtcggggcgtcggcgttgcggtcgttggtgattaagtaggagtttcgcgaggaggatgaagttaagtagttggcgttggtcggtttttttttttattatgtcgtcgtcgtcgtcgtcgttttcgtattcgtattcgtattcgtcgttcgcgtatttggtcgtttcgtatttgtagttttagatcgcgtattgcggttagattattatgtatttgtagttcggttattttacgtcgtcgtttacgttcgtgtttagttcgtatttcgcgttcgcgttcggtgtcgtcggtttgtcgggttttggtagcgcgtttaaggggttgggcgtcgcgtatttcgattttcgcgcgagtggcggtagcggcgcgggtaaggttaagaagtcggtggataagaatagtaacgagtatcgggtgcggcgcgagcgtaataatatcgcggtgcgtaagagtcgcgataaggttaagtagcgtaacgtggagacgtagtagaaggtgttggagttgattagtgataatgatcgtttgcgtaagcgggtggaatagttgagtcgcgaattggatacgttgcggggtatttttcgttagttgttagagagttttttggttaaggttatgggtaattgcgcgtgaggcgcgcggttgtgggatcgttttgggttagttttcggcggggatttagggagtggtttggggtcgtcggatttcgaggtttgttcgagtcgtgcgagttaggattaggagatttcggtgttttttgaaagtttggtttgtttcgcgtgttttttttttttttttgcgtcggatttggtgcgtttaagatgagggggttaggcggtggtttttttttgcgaggaggggagaatttttggggttgagttgggagttcggtaattttagtatttaggataattttgtgttttggaaatgtaaatttatcgttttaatgtttattgagtagggggagtaaatcgtgttttgttattttatttggaggttttttgtttttttttcgaggttatagtagatttttatgagagaaggaggggagtaggttcgtggtaggaggagggtttagggagttgagatttcgataagttcgttagttttagtcgtttttttacgtttgtttttagaaaggggtggaaatatagggatttggggtttggaatttaaggttgtttttttagttttatatgaaggtggagggtttttagttttacgttttttttattttttttcgtatatattttattttagtttgttataggttgggtttttttttggggcggaatttattgcgatgggggttattaggtgattagtgggagtttttatttcgagttatattagaaagttaggtcgtgggttagttttgaggatgtatatttttggtgggagagggagatttagagatttggttgtggggcgggtatggggggtgaagggttattgggatttttagttttgtttgtattgtatgtttttagtattgtttaggaatacgaagtacgattagtttattttagagggatcggagttatgataagttttttaaatattttgttttattagtcgatattaatatttgtatttggtttttgtgttttagtagtgttttgtgtaatgtgaatgtgcgcgtttttgttaaattattattttatttggtttttgttttgttttggttttgttcggatatttgttaaaatgagatttttcgtcggtagttgggggaagggtttgagattttttttttttttggttttgggattatttttgattttgggggattaatgaggtgaggggggtttttttttgtttttagttttttttagttttttcggtttgggttgtttataaggtttgttttttagaggttttggtttttggtcgggaagggaggtggtttttcgttaacgtattattggggttgggagtagggaaggacggtttggttttttttttttggggagaacgtagagttttattttagatgttttatgtattatatttataatataaatatattaaagttaatgtcggtgtttttttaaaattagaaagaagttatttttaaggttgtttgtgggttaggttatatttgtaaataatatagtattttttttggcggtaattttgatttttatgagttttttatttattttgagttttttttattttaagggggtgatttattttttttaggtaagataaataaatagtagaggataaggttttaaatggagtatgtttagagtttgaaggtagttttttggggttaggggagggggttgaaggggttattgggttgaggttttggcgaggttttttatttgtttcggggaggaggagagggagttttttgtttgaggggtaggtttggttaagtagttttaggtttaaggagttttttgtgtagatttttttgtaaattatttatagttgtagttttggttatttatatatatcgtagttttagattttagtaggattttcggttagtaggaagaggtttttagtggtaggattttttaatttttttttttttttttagattatgtggttatattttatttttgcgaggttcgaaggtagtttgaagagagagatttttttatttagttttttatatttgtttagttttagtttttataagaaagggggttgaggtaggtttgtaataggggtttggttttgttttatatattggttgtttaagaatttatttagtatttatattttttattgtatttattttagatttagtaggggattgagtgttggtgtgtttttaattttaatgagtattttgtaaggttaggtatttcggtatttttttagtagtagtgatagttaagtaagggagggtagtttttatttttgaattaataaggttcgggagaaagaggtttaggaggttgatggtgttttttagattttatttttat

SEQ ID NO: 10 - DNA, 8543 bp, Artificial Sequence
  chemically treated genomic DNA (Homo sapiens)
gtgagggtaaaatttgaaaagtattattagttttttgggtttttttttttcgggttttgttagtttagggataagggttgtttttttttgtttggttgttattgttgttaagggggtgtcggagtgtttgattttatagggtgtttattggagttgggggtatattagtatttagttttttgttgggtttgggatgaatgtagtggggagtgtggatgttgggtgggtttttgaatagttagtgtgtggggtaggattagatttttgttgtaggtttgttttagtttttttttttgtgagggttggggttgggtaggtgtggagggttggatggaggggtttttttttttaggttgttttcgggtttcgtaggggtagggtgtagttatatggtttagggaaagaggagagggttggagggttttattattggaggtttttttttgttggtcgagggttttgttggaatttggagttgcggtgtgtgtgagtggttagggttgtagttgtaggtgatttgtaaggaagtttgtataaagggttttttgagtttagggttgtttagttaggtttattttttaggtagaggatttttttttttttttttcggggtagataagaagtttcgttaaggttttagtttagtaatttttttagtttttttttttgattttaagagattgtttttaggttttggatatattttatttggagttttgttttttgttatttatttgttttgtttgggggaagtaagttatttttttagggtaagaggggtttaggatggatggagagtttatgaaagttaggattgtcgttagggaaaatgttgtattatttataaatgtgatttggtttatagataattttggaagtagtttttttttggttttaaaaagatatcgatattgattttgatatgtttatattatagatataatatataaaatatttagagtgagattttacgttttttttaaaagaagagaattaagtcgtttttttttgtttttagttttagtgatgcgttggcgggaggttattttttttttcgattaggagttagggtttttgggggataagttttgtgggtagtttaggtcggaggggttggggaaagttgagggtaaaggagaattttttttattttattggttttttaggattaaaagtaattttaaaattaaaaggaaagggagttttagattttttttttagttgtcgacggagagttttattttggtaagtattcgagtaaaattaaaataaaataaaaattaaataaaatggtggtttagtagagacgcgtatatttatattgtataaggtattgttggggtatagaggttagatataagtgttgatatcggttgataaagtaaaatatttggaaagtttgttataatttcggtttttttgggatggattgatcgtgtttcgtgtttttaggtaatgttgaaggtatatagtataaataaggttgagggttttagtggttttttattttttatgttcgttttatagttagatttttaggttttttttttttattaggggtatatatttttagagttgatttacgatttagttttttggtgtgattcggggtgggggtttttattggttatttggtgatttttatcgtagtgagtttcgttttaaggggaagtttagtttatagtaggttggggtggggtgtgtgcggagggaggtgggagaggcgtggaattagagattttttatttttatgtagaattaggggaataattttaggttttaagttttaagtttttatgtttttatttttttttaaggataggcgtggaggagcggttggggttggcgggtttgtcgggattttagttttttgagttttttttttgttacgggtttgttttttttttttttttatgggggtttgttgtagtttcgggaaggaggtaggaaatttttaaataaaatgataaggtacgatttgttttttttatttagtaggtattggagcggtgagtttgtatttttaaggtataaggttattttaaatattagagttgtcgggtttttagtttagttttaagaattttttttttttcgtagggagaagttatcgtttggtttttttattttagacgtattaagttcggcgtagaggaagggaggggatacgcggagtaggttaggtttttaggaggtatcggaattttttagttttggttcgtacggttcgggtaagtttcgagattcggcgattttaaattattttttgggttttcgtcggaggttggtttagggcggttttatagtcgcgcgttttacgcgtagttgtttatggttttgattaaggagttttttggtagttggcggaagatgtttcgtagcgtgtttagttcgcggtttagttgttttattcgtttgcgtaggcggttattgttattggttagttttagtattttttgttgcgtttttacgttgcgttgtttggttttgtcgcggtttttgcgtatcgcgatgttgttgcgttcgcgtcgtattcggtattcgttgttgtttttgtttatcgattttttggttttgttcgcgtcgttgtcgttattcgcgcggaggtcggggtgcgcggcgtttagttttttgagcgcgttgttagggttcggtaggtcggcggtatcgagcgcgggcgcggggtgcgggttgggtacgggcgtgggcggcggcgtggggtgatcgggttgtaggtgtatggtggtttggtcgtagtgcgcgatttggaattgtaggtgcggggcggttaggtgcgcgggcggcgggtgcgggtgcgggtgcgagggcggcggcggcggcggcggtatggtaagggaagaggtcggttagcgttagttgtttggttttatttttttcgcggggtttttgtttgattattagcggtcgtagcgtcggcgtttcgacgcgttcgtataggggttttagtttgtcgtttaggtagtcggcggtcgcgtagtcgtagtcgggcgggggttcgtgcgttttttcgggtatgacggcgtcgtcggggttcgcgggcgcgttcgggtagttaaagtcgtcgtcgtcgtcgtcgttcgtggggtttacggtcgttttggtttttttttgttgtcggttgtgttggaataggtcggttaggaattcgtcgttgaaggcggtcgggtcgatgtaggcgttgatgtcgatggacgtttcgtgttcgtagatgtcgtttagcggtttcggggcggtaggtggggcgggaggttgcgcggggttcgcgtttcggggaaagtcgaaggcggcgttgttgggcgcgtgcggggggttttgtaggtggttgtttatcgggggtcgcggtttcgtttcgtagaagtcggtcgattttatgggggagttagagttttttcggtatggcgagtttcggcggtttttagtttgcgcggggcgtcgtcgtcgtttattcggagattttgttcgttcgcgttcgcgtattttcgggtcgcgaatggttcggttcgcgtcggtttagtttttatattcggtaggtcgcgtcgttttttagagttcgaggcggtttttgttttcgggttgcggcggcgcggcgtttgttgggttttagcgcgcggtcggtatggggcggcgaattagcgcggtatagcgtcgcgttttttaggtaggtcgcggcgtaacgtttatcgtttttagcgcgtttagtagagtcgcggcgttcgttttaagtttcgttttcggttcggtcgtcgttttcgcgtttacgtggtcggtagcgggggttttttttttttgtttgttttaggcgttcgtatttagttacggtcgggagtttaggagtatttcgaggttgtacggggtaggggtggggggcggagggcgagttttggttttgagttgttggggcgcggatttttttttaaagttagaattaggtttgtttcggattcgcgtttcggggaggttgtagcgtagagtagcggggttggggtcggtggggggtcgtttgggacgcgcggagaggttttgagcgcggtggttttgcgttttttagttttgatttttaggttatttttgtgatttcgcgtagaggtatttttcggaggacgtcggggttttatgggcggcgtcgcgtagggcgttaggatttcgcggggagcggaggcggtttcggttcgggagtttggaggatttggtcggtcgattcgttcgggttggaaaattttttttataattatttttttaggtcggagcgcgcggtttgttaggcgcgcggggtcggcgttgtttattcggcgtggagtcgtcgatttttttttttgcgggatcgcggggttttttagattagcggagttggacgtcggggcgagtacggggaggggcgtatcgagggaggagataaatttaattttggggtcgggatttcgaggcgggggtcgtagcgtttcgaggttcgaagttatcgttttttttttcgtttttttatttaggtgggcgttaacggcgggagcgagggtgtttaggtcgtcgggttgttaggttcgagtacgtatagggagaattttgtttagtggttcgtcgggcgttgtagttttcgggattttagggatcgaggcggttaggttttggggttttttgagtgcggtagttaatgtttttatcgcggcgggggaaggagtttgttatcgagatttttagttacgtgcgtttttcgtattttttatcggggtcggggtggcggttacggatcgttagttgggtttagatggagttttgggagtttttaagtgttttttgtttttgttcgcgtcgtttttcgttattggcgttgaggtttgacgtcgtttgcgtttcggttagaggcgcgtttgtttataggtgagggaagattttttttatcgatagtggttttaggtttggtaaggcgttacgattcgtttaggagtttcggagggggtatagttaaaaatatcgttggagagtttcgagtttttacgacgatcgtagtaaagaagtagttttatttgggtaacgtatattgcgttttaattaagtttttatttaatatagttttagtgattaatagtttaattgtttcgttttcggtttagagtttataaataagatatttttagtttgacgtttttggacgggagggagtaaaaattagatacgttaaataaatatttcgatgtgagtcggagagttgtttgttgagttaaatgtaggatttatttatatagtatttatttgtggagggagatttggacggaaattaaaaagtattaagagcgatttgcgtttttttttgcggtgttaaaattaatggttttttttatttaggaataaagaaacgttattgtatatgtacggttttcggtttgtggagttgtgggaggaaggcgatgtttggttttttttgtatagttgttgttgtttgtttagagatcgggaattttgtttcgtaggattggaagaaattttagtaatgggaataagattttgtttaatagggggttgatgaatgtgtgggggcgataatggtaaggagtgggattttcggttcggggttcgttaattttaggggttataggtttttttataattgaattagaatttatttattcgggtttgttttgtgtagggtgtcgagagtttagggatgtatgagagggtggtttttgtttttgggaattgggatagtgggagagacggataagttgttatatagaggttgttgggaggaaggaggagatagaaggagtaggggatgggattttatttatttattaaatgtatacgaggtataaatgggaattaagggtggatgtgttgtgatgaagagaagttttgttttgaataaggtggcgttgtggaggaggtagagattagatttgtttgcggaggtgttatggattgaattgtgtttttgttttaaatttttatgttgaaggtttaatttttatgtgattgtatttggagataaggtttttaggaagttattaaagtgagatgatgttatatgggtagggttttaatttgataggattggtggttttattagaagaataatgttatgggtatgtatagaaaggaggtggtcgtttgtaagtagggaagaggttttttattagaatttgagggtgttggtagtttggttttggttttgggtatttagtttttagaattatgagaaataaatgtttatggtaggtttatgatggtagtttgtttggattgaatcggcggtgagatagggttttatgtaggagtagatttttgagttgggttttgaaagttgagtaggaatttgttggaaggataagggaggaaggtttttttaggaggagggaatggtaagtgtaaaggtggagagtttgttagtgtatgtgttttggtaataaagaacgagatggttggtcggttggagagtggggtgagggagggtggggtttagataaggttggattcgtagatagggttgggttgatggttaaggttattgtaggtgaagggggaatttttattttttaggtttttgatttttagattttagtaggggagtttcgttgtcggatttgggtttttgagaatttattttggttaagacggagagggggtgttgattagatgggaaaggatggagatttgtattgttttagtaatgagcgggtagggtagattagaataagatgttaggatttgggggttgaatgttaggtttttggttgggattattattttttgatatatataatgtttaggaaattggaggtttttttttaagtttttaggaggttattggggatttattttaggatatttatttgtttgttttgtggttttggaggggaagattttggagtagttgcgaagatttatttattatgttttggtttttttttggaagtttaaaagtgtatttcgggatgaggaggaaatggttttgagggtaagtggtaggtttttggttaggtttggcggggtttttagaggatagggggtgtttagggttttagatagaagtgttttgtttaagttttaaagtaggaaattagttggggagttggggtgagattttggggtcgatggaggtattttttatgggagagttttatagggtaagggagagggggttgatgtttgatagttttatagatagttggtttgtggttggagaagtgggagtaaaggagaaattatttttgattgggagaagtggttttggtttatgtgtaattgagataaagttagttttaagagtagtttgtaaatttttttgtgattatttttaaggtttttttttttgaggttgtggatgggggtgtatataggtttagtgtggggggttgagcgtgagttttcgggaaacggtggttttgagttttggatgttttaggatgaagtttgattttggagttaattatagtattaattattttgagaagataaatagagttttagaaatgttttattttattttggtttaatttttttaatgtaaggtttacgagagaattagtacgtaagtttggaaattaattaaattttgaagagtaaaaacggaattaatttttttgatgtagttttttgattttatttgaagttgaaatgtgtgtgtaagattggtcgttttaaataggattaatttagataagataaaagtttagaattatgattttaggtttagttgagttttggttaggggtataagtatttaatatggtatagttaataatgttttaattatttaataagatatttttaaaggtttttttttaattagataaataaaataaaataaaaatattagttattttttgttataaatggatttataaacggttttatattgatttattttaggttttagattttgatatgtaaagtatatgaatttaacgtataattaatttaaagtttagtgtttttttttttttttttttttttttttcgagatagggttttattttgttgtttaggttggagagtagtggttggattttagtttaatgtaattttcgttttttaggtttaagtgatttttttatatcggttttttgggtagttgggattataggtatgtattattatgtttggttaattttttgtatagatggggttttattacgtagtttaggttggtttcgaatttttgagtttaagtgatttttttatttcggttttttaaagtgttgggatttataggtgtaagttattgtgttcggtttagtgttttttatttataggcgtttagttttatttatgagattatttattttgtttttttaggaggtaggtggtgtagggagttgttgggaggattagggagaatgttgtgttaaggttagtttttggtatgtaggatatatttgtttagtaaataagagtttggtatacgtttttttattttttttgtttttttataagtgtatttttgaggttttagttttttttaaaattttgaatattaagtaatttatttttttttttttttttttttttttttttttttttttttttttttt

SEQ ID NO: 11 - DNA, 6270 bp, Artificial Sequence
  chemically treated genomic DNA (Homo sapiens)
attagtatagtttgagtcgagtttgtggagagagttagggtttgaggagtttgatgggagggtttgggaggtaaggttaggtttatttagttggatagagttatttgagaagaagagttagttttaggaggaagagtaggaggattattggattaggataggggaaaaaggaaaaagtcgttaaggtatgtataagtattttttggtattttgggttaattgttagaggaagttgatgggattagttttagtttttgttttgtgtttttgtttttatgggtcgtttttttggttgcgtgttttgggatagtattattttagagttagtattgttggtagatgtagggtaagggcgggagtaagggggtggtggaggggtagtggtgttaagatattattttttattatttggaatattgtgaggatataggtaggtaagatgtcgttatttttagttttggtttgacgttaatatttttgttttgtggttgttatttttttagataggttggaagttcgttatttaatagggacgttgagttgggaggcgggttatttaatagttgtgtgtttttgggtaagttattttatttgtttagtattttgagaaagaaagagagttggatttaattttaaatagttttttaattttttaattttaggttgttttaaaaggtagaggttgttagttttgtttaagttttatatgtgttttttgggttttttttttttagtatatatatttttttttttttttttttggattgttttaggtttttttttgttgttttatttgagtatgttttgttttttattttttttattttatgaaggtatttgttttttaggagtattttttttttttgtgatatttgttgatttttttaatttggttaaatgggtaaatgtgggtttttttttgggtaataaatatttatttttaatttggttatttttcgttttaattttgttagttattttaattttaggagttttatatgttttgattttagggaatttgggaatattttgaaagttattgaaattgtagttgtttatgtatttatttattaatgtggttatacgataaatttttttgtgattattttgttaaagattttgttatatgttgtggaaatagtaaatttttttttgatttttttaagttagtatagattttaaatatttttttttattgtttttataaagatatttatttgtgttaatttgtttgtttttttttttttttttgagacggagtttagttttgttgttaggttggagtgtagtgacgcgattttggtttattgtaatttttgttttttaggtttaagagatttttttgttttagtttttcgagtagttgggattgcgggtacgtgtcgttatatttagttaatttttgtattttttttttttttagtagagatggggttttattttgttagttaggatggttttgatttttcgatttcgtgatttgttcgttttagttttttaaagtgttgggattataggtgtgagttattgtattcggttttgttttttattttaatttaggaaatatggttattatagttgaagaggtttaaaagatgtaattgattttatttttaaagagtaaatagtttgttaggggaacgaagttaaggatacgtacggtatatatatgtgtgcgttttttggttttatagattatttatgttttgttggaattattgtttgtgggtttttttgttgggtagtgagttttattggcgagggttaaatttaatatatttttagattttatgtagtgttttatgagtatttatatgtttaaaaatgtttgttaaattgacgtattatattaggtagtaggtagtgtttgtttaggagatatagataaaattgtaatgagaggttagaggaagagaagaaggagattttatatttattaagattagatgtatgatatatattatgttatttatagtttaaattaaataattttatgaaggaggtattattattgttattttgtaaggaagattaagtaatttgttagggttatggagttggttagtgacggaggttagatttgagtttagtttttttttaatattttatagttatgtttagttatttttttattgggaaagttttgatttattaaggaggtggtattggaaggaggtttgttataaagttattaagataataaatatgtattattttagttaatttaaagaggtagtaattgtagtggttaaggaaaaatgattttgttgattcggtagagtttttttttttttttgagtaagaattttttagtcgttgattggtattgttttttttattttttatttttgtttagagtttttttttttgtttagagttttttttattttattttgatatttagagttttgtttgttttagttaaatttttgttattgggaaatattgaggttagtatgttagtaacgttagtattagtcggggaggttagggtagagatttattttattatggttaaagttgttgatttttttattttttgcggttttgtttgtatattttttatatttttttgtgtttagtttattgaagttattgatgtagatttttttttttttacggtggttaaatgagggttaggaaggtttttcgagttatatagtaatttttttttatttttttagttagagacgaattaggtattttttttggatgattttgggtagtttagttttttagttttgttttttttgtttataaagtaggaataaaaatattgtttgttttgtttattttttcgtataatttatagggaaagagtatgaaaaagtgtaggttttaaggattgaaaaagtattaatttattagaaagtataaggtttatttattattattattttaaagtaggggagggaatagaatttttttttatggagataaggttttggatttagtattggtaggttgtttattttttttggaattgtattgtaagattttattttagttaggttttttttttttttttttagatgtttcgtaggagtttgtcgagagttagcgttgtgagaggttgttttttgttgtttatttgagttcggattatagtagtttttcgagttcgaaatattggggttaatattgttatttggtggttaatataagtattgttattaaattgagagtttagttttgaaatggagaaatttttttaatttttgatatttgtttttgggttatacgtagatttttttatattaggttattgtgtttttagataaagtatatttggttatgttttaagttatgtatagagagtatttggggtaggtgttggggtagggaggatgtaaggaatatgttaatcggaatatgttaattagaatatgtatttttaaaattttaatgtttaatgcgatatatattttttttgtatttgttttattgtggtttatttatagtgaattattttttgtttggtttaatttataaaaatttttggtttttttggggtatttatagtatttgttggttataaaagagttagtaatatttttatgtgtttttttttttttttttttaattggatttataattttttttggagatgaaatttaataggtaaaagtagtattagagtaggtgtttttgaaaggaggtagtggggagtttttaaaggaaagagaaaagggaagaggagagttagtatagaataaagaattgtagagagggagttatgggttttttttggagattttaaaatagagttttaggaagaggtgatgatataagaggttttttaaattttataagaggaagtagatttaagagatacgtattggagattagagagcggttatgtaaaaggaaagatagtaaacgagttgtagtaagtttttaagttttgtagtttaggtataggaaattagaggtagagttttaggtttagggtgaggggcgaagtattagtttgagttttttgtagtatagagtagttggaagagagaagtgttggagttatcggaggattatggttgtttatttcgagggtagtaatttgtttaggtttgcggtgtaaggtttaagttttgattaggtgttttggttaagtttagggagttaggaagtgtattaggttgttagaggtagttagggttggaaacgtattaatatgtgggttattgtatagtttttgtgtaaaaatttagtaaatgagtatgttttggagtattacgtaggttcgcgtgtagagtttgtttttaggatttattattattttttagattttttaaaaaataaattttggtttatatttagagaatgttttgggaggtggggttataaaagaaatttttttttgggggtaggtggagtttagtagtaggggagagttagaggaaggcgtgttaagggaggaggtgagatttaattgagggtaggtattggaagagggttttttttttttattttaatttggaattttattttgtatagaatttttttaaagtcggagggaggaggttgtttagagtggggtgttgttttttgcgaggatttggagttttttggttttttagtagggagtggagaggtatttttagaagtattagtttcgggtatttttagaattttggtttggtttttgattaaggagtgtttttaattgttgaataggttaggagtcgtttttttttaaggtttatatttttttttttggggtgtgttttgtttttttttgagttattttaaggggagagaggggaaaaaagggaagagaagagaggtattgattatagaggaaggaaaaggaagtagagtagaggggggagagaggttatataggagtgggtgatagaggagattgtagagggtaggtttagggtagaagatcgagagagggtaggtttaggttaggaggaggtagagagagggtagtcggagtattttaaggggtgttttaagagtaggtgggggcggggagtcgagggggcgggtcggttatgttttacgggatttattacgagtgtgagtttcggggtggttagtagttattcgagtttttagggggtcgagttgggttcggggagttaggggatatgtgtgagtatgaggtttttattgattttttcgtttatatcgagtttggggaagagtagttttttttcgatttttttgtcgtgaagttagcgtttgaggttagaggttttaagggtttcggaatttttgtttttttttattatttgtcgtttgattttcggttttttgtttattttttatatattttcggtttagataggaaggcgttggggtttggtatttatagtagtttagggagttacgattttagggttgtggcggtgaaggaggagtttcgggggttagagggtagtcgagttgttagtcgaggtagttataattttttgtagtattaagtggtatattgtgggtagatagttatgtatttgtttttaattttggtagtattcggttagtttttgcgcgtttttaaggtaagagtaggttagttttttttttttttgttcggggttggagaggttggtgtggataggattttgtgtttcggtttatgttgttgagtttgtgtttggtgtcgttttgtgaaatggatttaatttatagttttttgtgtttatattttattatgatttttttttttttttttgtgaatttatttttattttgaatttttatttaaagtttttgtggtaagttgatttatttgattttaggtttttatcgttagtttttttgttgtttattatgttttttttttttgtttttttgtcgtttgtttttgtgagaaatgtttattggttatagaacgggagatttaaggtagattgagggaaagtgtatttagaaagtgtgagagtattggttgggtgtcgtggtttatgtttgtaattttagcgttttgggaggttaaagtaggaggttcgtttaaggttaggggttggagattagtttggataatatagtaaggttttatttttataaaaaaagaaagaaagaaagtgtgagaatatgaaagggagttttggttttaagtagaggattttgtgtatttgggttattattttttagaagtagagcgatgatagttttgatttgagagataggagttggttttgagttttgtatttttttgacgtattaagtgtgttttggttgtcgagattttcgtttcgttttcgttttgttttttggttagtttttattttttcgttttttcgtgtttttttttttagg

SEQ ID NO: 12 - DNA, 6270 bp, Artificial Sequence
  chemically treated genomic DNA (Homo sapiens)
tttggaggggaaggtacggagagacggagaggtgagggttggttaggaggtagagcggaggcggggcgggaatttcggtagttagggtatatttgatgcgttaaaggaatataggatttagagttagtttttgttttttaggttaaaattattatcgttttgtttttgggagatggtgatttagatgtatagggttttttgtttgagattaaaatttttttttatgtttttatattttttttttttttttttttgtaaagatggagttttgttatgttgtttaggttggtttttaatttttggttttaagcgaattttttgttttggttttttaaagcgttgggattataggtatgagttacgatatttagttaatgtttttatattttttgagtatatttttttttaatttgttttgagtttttcgttttatgattagtagatattttttatagaagtaggcggtagagaaataagaggagggggtatggtgagtagtagagaggttggcggtgggggtttgagattaagtaggttagtttgttataggggttttgggtggggatttagggtgggaatgaatttatagagaaggaaagggaggttatggtggggtgtgaatatagaggattgtgggttgggtttattttatagagcgatattaagtataggtttagtagtatgagtcggggtatagggttttgtttatattagtttttttagtttcgggtaggagggaggagggttggtttgtttttattttgagaacgcgtagaggttggtcgggtgttgttagagttgggggtaggtgtatggttgtttgtttatagtgtgttatttggtattgtaggggattgtagttgtttcggttggtagttcggttgttttttggttttcggggttttttttttatcgttatagttttggggtcgtagttttttgggttgttgtagatgttaggttttagcgtttttttgtttgggtcgaaggtatgtggagggtaggtaaagggtcgagggttaggcggtaagtagtgggggaaggtaggggtttcggggtttttgaggtttttggttttaggcgttggttttacggtaaagagatcggagagaagttgtttttttttagattcgatgtaggcggagaggttaatggaggttttatgtttatatatgttttttagtttttcgggtttagttcggttttttgagaattcgagtggttgttggttatttcggggtttatattcgtagtaggtttcgtgggatatggtcggttcgttttttcggtttttcgtttttatttgtttttgaggtattttttggggtgtttcggttgttttttttttatttttttttgatttgggtttgttttttttcgattttttgttttagatttgttttttgtagttttttttgttatttatttttgtgtggttttttttttttttttgttttgttttttttttttttttttgtagttaatgtttttttttttttttttttttttttttttttttttttggggtgatttagggaggggtaggatatattttagagggagagatgtaagttttagagaaaggcgatttttggtttatttagtagttggggatattttttggttagggattaagttagggttttggagatgttcgaagttgatgtttttgggaatgtttttttattttttgttgggaggttaggggattttaaattttcgtagagggtaatattttattttgagtaatttttttttttcgattttgaaaaagttttatgtagaatgaggttttaagttagagtgaagagagaaagtttttttttagtgtttatttttagttgggttttatttttttttttgatacgtttttttttggtttttttttgttgttgggttttatttatttttaagagaaagttttttttgtagttttattttttagagtattttttgagtgtaggttagggtttgttttttgaggggtttagggagtagtgataggttttaggaataagttttatacgcgagtttgcgtggtgttttagagtatgtttatttgttaggtttttgtataggagttgtgtaatagtttatatgttagtgcgtttttagttttagttatttttagtagtttggtatattttttaattttttgggtttggttaaagtatttggttaggatttgggttttgtatcgtaggtttaggtaggttgttgttttcggagtagatagttataatttttcggtggttttagtattttttttttttagttgttttgtgttgtaagaggtttaggttggtgtttcgttttttattttgggtttgaggttttgtttttggttttttgtgtttgggttgtagggtttaggagtttgttgtagttcgtttgttgtttttttttttgtatggtcgttttttgatttttaatgcgtgttttttgggtttatttttttttgtgaggtttgagaagttttttatgttattatttttttttggggttttgttttagggtttttaggagaagtttatggttttttttttgtaattttttgttttgtgttggttttttttttttttttttttttttttttgggaattttttattatttttttttagagatatttgttttggtattgtttttatttgttgaattttatttttaaaagggattgtaggtttagttggggggggggggggaaggatatatagaaatgttattgatttttttatgattagtaagtgttatgggtgttttagagggattagaagtttttgtaagttgggttaaataaggggtggtttattgtgagtgggttatagtaggataagtgtagagaggatgtgtgtcgtattgaatattaaaattttaaaaatgtatattttgattagtatatttcggttagtatattttttatattttttttattttaatatttattttagatgttttttgtgtatgatttgagatatggttagatatgttttatttgaaagtatagtgatttggtgtggggagatttgcgtgtaatttagagatagatgttaggaattagggagatttttttattttaaagttgagtttttagtttggtggtagtgtttgtgttgattattaggtggtaatattggttttaatatttcggattcggagggttgttgtggttcggatttaggtggatagtagagggtagttttttatagcgttggttttcggtaggtttttgcggggtatttggaaggaggaagaggaaatttggttgggatggggttttgtagtgtagttttagggagaatgagtagtttgttagtattgggtttagggttttgtttttatgaggagaaattttgtttttttttttattttgaaataatgataatgaataggttttgtgttttttgataaattaatgtttttttaatttttgaaatttatatttttttatgttttttttttgtgggttatgcgggaaggtaggtaaggtagatagtatttttatttttattttataaatagggaaaataaggttgagaggttgagttatttaaggttatttaaggaggatgtttggttcgtttttggttgaaaggatgggaaggggttgttatgtgattcggagaatttttttggtttttatttggttatcgtggggagggggaagtttgtattagtagttttagtgaattgggtataggaggatgtgggaggtatgtaaatagagtcgtaggaaatgagaaagttagtagttttagttatggtgagataaatttttgttttggttttttcggttagtgttgacgttgttggtatgttgattttagtgttttttagtaataggggtttggttggggtaggtagggttttggatgttagggtagggtagggggagttttggataggaaggggagttttggataggaatgggaggtggggagggtagtgttagttagcggttgggggatttttgtttaggagaggaaagaagttttgtcgggttagtaggattatttttttttggttattgtagttattatttttttggattaattgaaatgatgtatgtttgttattttagtgattttgtaataggtttttttttagtgttatttttttggtgaattaagatttttttagtaggaaggtaattgagtatggttgtgaagtgttaagggagaattgggtttaaatttggttttcgttattgattagttttatgattttggtaagttatttaattttttttgtaaggtggtagtagtaatattttttttatagggttgtttaatttaaattgtgaataatataatgtatgttatgtatttggttttagtaaatgtgaagttttttttttttttttttttgattttttattgtagttttatttgtgttttttaaatagatattatttgttgtttggtgtggtgcgttagtttgataaatatttttgagtatataggtatttatggggtattgtatggggtttggggatgtgttgggtttagttttcgttagtagggtttattgtttagtaggaaggtttataggtagtggttttaataaggtatgggtggtttgtagagttaggaagcgtatatatatgtgtgtcgtgcgtatttttggtttcgtttttttggtaaattatttgttttttgagggtagggttagttatattttttggatttttttaattatggtgattatattttttgaattaaaatgaaggatagggtcgggtgtagtggtttatatttgtaattttagtattttgggaggttgaggcgggtagattacgaggtcgggagattaagattattttggttaatagggtgaaattttatttttgttaaaaaaaaaaaaaatataaaaattagttgggtatggcggtacgtgttcgtaattttagttattcgggaggttgaggtaggagaattttttgaatttgggaggtagaggttgtagtgagttaagatcgcgttattgtattttagtttggtaataaagttagatttcgttttaaaaaaaaaaagaaggataggtaggttgatataggtgaatatttttatggagataatggaagaaaatatttgaagtttgtgttgatttagaaaaattaggaaaaaatttgttatttttatagtatatagtaaagtttttgatagaatggttatagaaagatttgtcgtgtgattatattaataaatgaatgtataagtagttataattttagtgatttttaaaatgtttttaaattttttgaagttagagtatgtgaaatttttaggattaaagtgattggtagggttaagacgggaaatggttaggttaaaagtaaatgtttgttgtttaggaggagatttatatttgtttatttgattaggttgaaaagattagtaggtgttatagaaagagaaggtgtttttgaaggataagtgtttttatggagtagaagggatgagggataggatatgtttaaatggggtaatagggaggagtttggggtagtttagggaagggaaaggaaaggtgtgtgtgttgggaaagaggggtttaaagggtatatgtgaggtttggataagattggtagtttttgttttttgggataatttaaagttggaagattgaggaattgtttgagattaggtttagtttttttttttttttaaaatgttaagtaggtgaggtgatttgtttaaggatatatagttgttgagtggttcgttttttagtttagcgtttttgttgaatggcgagtttttagtttgtttggaagaatgatagttataaagtaggagtgttggcgttaggttaggattgggagtggcggtattttgtttgtttgtgtttttatagtgttttagatggtgaagggtgatgttttaatattattgtttttttattatttttttattttcgtttttgttttatatttgttagtagtgttggttttggaatggtattgttttaggatacgtagttaggagggcggtttataaagatagggatataaagtaaggattggggttaattttattaattttttttagtagttagtttaaaatgttaggaagtatttatatatattttaacgattttttttttttttttttgttttagtttagtggtttttttatttttttttttagagttaatttttttttttagatggttttgtttagttgagtgaatttagttttattttttaggtttttttattaagttttttagattttgattttttttatagattcggtttaggttgtgttgat

SEQ ID NO: 13 - DNA, 10286 bp, Artificial Sequence
  chemically treated genomic DNA (Homo sapiens)
tttaattaaagagtttttattaatgtagaatgattgataattatattattattaatatattgtaagatattaattgaaatttaaatttgacggatatttttttagtttttaaatattatagatatagtttggattttttgttaaaggtggttaatttggttgtttagttttttagaaattttttaaatatatattaatttattttagtttgtatagtaaatttttattgatttggtttttaaatataaaaaaattaaattattaaattgtttttttattttattttgtggaaataaatgaaataaggtgtggtaattaaggaattgttttaaaaataatattttttaggatataatatagggttaatattatgatttttaatattttgtgtgtttagtgtttgaattagtaaagtagtataagtatagtttggttttattttgtagtgtgttttagtttattatgattttatggatgtaatttgtttataatttatgtatgagtatcgtggtaataatagttaatattttttttattttttgagattgagtttcgtttggttttttaggtcgatttaggtttattgtaatttttgtttttcgggtttatgtgatttttttattttagttttttgagtagttgggattataggtatatgttatttattatatttagtattttgggagatcgaggtgggagaattataagtttaggagtttgagattggtcgggataatatagtgagattttatttttaaaaatattttattttttaaaaaattttaaaaataaattaggtgtggtgatgtacgtttgtagttttaattatttgggaggttgaggtgggaggattgtatgagtttaggagtttaaggttgtagtgagttatgtttatgttattgtattttagttttagttttttaaagtggtgggattataggagtgagttattttagttagttatgtagttaatatttttgaggtattaagtaggtattgttttaggggtttagtatattaatttttttaatttttagagcgatattgttgttttttttatttatagatgatagagaggttaagtaatttggttaaggttgtatatttagtaagcggtgaagttgtggatattagtgtttatattttttaggtaattaatgtagttaattatagtggttgttaggtaattataatatttaatgaatataatagtttattttttaagttttttggagggtttttttattttaaatttttttaaattaaatagagatgaggggttttattatgttgtttaagttggttttgaatttttggttttaagtgatttttttatttcggttttttaaagtgttatagaggttatttagtttttggatttgtagaatatatattgattattgtaaggtagagagatatgtaggaaattttttttttattgtgatggtttggatttttgtgatttgtaaaaaaagttatatagtagatttttaaggttttattaggttttcgtttttttatggagaataaatttttcggaagtttttattttttagggtaaaaatttgaatgttttttgggtttatatggttttgtttattttgttggtttttattttatttttagttattttagttttaaattttttttattatagggtttcggataagaattttttgtgattgttgtatttacgttttttgtattgtttagttaaattttgttaattttttaggttttttcggatttattagattaggtttggttcgtttttgattttttatagcgttttgtattgtttttttgtagtatttatgaaaatggtaattgaaaaattgtggattaggggaggtagtttatgtttgtaattttagtattttaaaaggtcgaggtgggtgtattatttgattttagttgttcgaaattagtttgggtaatatggtgaaattttattgttataaaaaatataaaaattagttaagtatggtggcgtatgttttgtagttttagttgtttgggaggttgaggtgggaggattatttgagtttaggaggtttaggttgtagtgagttatgtttgttttattgtattttagtataggtgatagaaagaaaaattgtgtaattattaaacgtttgtttgtttggttgtaagtgtaagttttatgtgggtagtgattgtgtgtttgttttgtttattgttgaatttttaatatttagtttacggtttagtatatagttggtattaaatgtatatttgtaaattgagtagaagaaaaattattagttattagttgaaaagaaaataaatattcgagtgttttgggtattgattagatttgttgggtgtgtaagaaggtttgtttagatatagatataaagaatgttggaatagtttggtagggcggtttgtaaattaaaggataattgaatatatttatgtaagtttttttttttttttttatatatttttttttttttttttttttttttttttatttttatttttttatttttgagatggagttttgttgttatttaggttggagtgtagtggcgtgattttagtttattgttaatatttgtttttcgagtttaagtaatttttttgttttaggttttcgagtggttgggattataggtattcgttattacgtttggttaatttttatatttttagtagagatagggttttattatgttggttagggtggttttaaatttttgattttaggtgattcgtttgtttcggttttttaaagtgttgggattataggcgtgagttattgtgtttggtttttttatatattttttaagtgattaggaaatatttagggtaaaattatgattttgtgagtaataaattataattttattttaatagtattaaaattttgattaaagtaagtttaggtaggatttggttatttatatttttaattttagtaatttgggaggtcgagatagaaagattatttgagtttaggagtttgagattagagtggataatatggtgagattttgtttttataaaatatttttaaaaaattagttaggtgtggtggtgtatgtttgtaattttatttatttgggaggttgaggtgggaggatggtttgagtttaggaagtcgaggttgtagtgagttgtgattaagttgtggtagtgttattgtattttagttggggtaatatagtaagatcgttttaaaaaaaaagaagaaaagaaatttaagttgagaatattgagagttaacgtgaagaaatatatttgttttaatgatatttatttttttaagtgtgtatttgtgagtattattatttgtttttttttttttggagatagggattttattttgtggtttaggttggagtgtagtggtttaattttagtttattgtaattttcgttttttaggtttaagttatttttttattttagattttagagtagttgggattataggtatagcgttattatattcggttaattttttgtatttttggtagagatggggtttttttatgttgtttaggttggtttttaattttcgatttgaagtgattagtttgtttcggtttcgtagagtgttgggattatagatttgagttatcgcgtttagtttattgttatatcgttgtgattttttttaatttttatttattgttttattattttattgatttttcgaaataattttacggggcgagtcggttttatgggcgttgaagaaatatttttttttttaaagttttaattgtttgaacgatacgcgttgttaaagaggaagtaattaaatttattaggcgagttttgtttttcgtttagcgagttgttgttttttggtgttaaaacgttttcggggttaggcgcggtggtttacgtttgtaattttagtattttgggaggtcgaggcgggcggattacgaggttagaagatcgagattatttcggttaaaacggtgaaatttcgtttttattaaaaaaatataaaaaattagtcgggcgtagtggcgggcgtttgtagttttagttatttgggaggttgaggtaggagaatggcgtgaattcgggaggcggagtttgtagtgagtcgagattgcgttattgtattttagtttgggcgatagagcgagatttcgttttaaaaaaaaaaaaaaaaaaaacgttttcgggtttttttggcgagttttaagttatattggatcgttgtttatttttagagattatttcgtatttatgtatttggaaggtatttaaagagaattattttaagaaatttattttattttattttaataataaagtatagtttgtagtatatggattttatttatgtgatattaatgttaattttatgtgtgaaatatttgggtttattcgattttttaaaaattagtaattgagatggggtttcgttatgttgtttaggttggttttttaacgtttgggtttaagttattttttcgtttcggtttttttcggcgttgagattataggcgggagttatcgcgttagtttttattttttttgcggcgataaagttcgttcgtttgcggggcgtttcgttcgtagaaattttgtgagggacgtcgcgggggtttttaagggacgcggcgaaattaaaatagtcgtcggtggtttataaaattattttagaaaatgtttttaaaggtacgtttggtttttataaggtgacggttttttagttttcgattcgaatttgagtcgtttatagtattaggtcgtcgttagttcgggcgagttgtttagggatcgcggacgtcgtagtaagtagttttttgttttcgttatattcgtcgagttagtcgcgcggaatttatttttttatcgtgggttcgtttttcgtcgttagtttgtttacgattggtcgattgggttgttcgtcgcgagagaaggcggtgttttcggtaggtcggcgtttttattggtcgggatggcggcggcggcgcgcgcggtttcggcgagtaggggaagtcggtggtcgcggttgcggaacgggcggaggttgtcggtttcgtaatcgtcgttttttttcgttgattcgcgggttgtgaggtttgggtcggttcgggtcgtatcgcgcggggtcgttcggagtggaggtcgtttgggggtaggcgggttagaggagtaggtaaggaggttgcggcgggcgttttgagaacggggaggaggaggtcgcggcgacgtcggtcgttcgattgggtgcgggttcggttcggggaaatttagtttcggttttagacggttcgttggttcgggaaggttacgcgaggttggaggcgcgggcggcggcgtcgcgcggcgtttgatgtaatttgtcggtaatattcggcggggacgttgagtttatttttggtcgcggtttagcgttgcggcgtcgttcgtcgattttcgcgttgttcggggcgtttttcgcggcgggtcgggagcgcgcgaacggtcggggaatgttttttgcggagttcggttttttttcggtgaaacgggcgttgtgattcgttaggttcgtattggtttttggggatgaagggtgtttttagaatagtagaaggtggatcgagtcgagttttagaattttgattttttagaagggtttagtttgcggtgatcgaaaatttgtttagaagtttaaagattgattaataaaatagggaaagtaattggtttttaaatgtatgattttgtagagataatattttgtttttttgtggagttgttggaatgttttgtattttattgttgaacgtagtttagaagaatacgtaatatttacgggtcgaatagagaagaaatgaagtatttcgtaggtatagttggagggagcggagtagggtcgatagttagcggaggtgattagatgcgaaggatggaaatgtatgtgtcgcggggggaggagagtgttttttagggtagttggtgtgttgtttttttttcgtaggtttacgtgttgggttttttttttgtttgaagtttatattgtaatttggtattttgaaatgtataagatttagaaaggttttaatgttgatgggtgatattaaaattggtagttgtgttagaattgattgtttatatgaataggttgttatttaaggtagattttttttaaagaaatgtgatttttagagaaaattttaaaagaaaattttataagggtttgttttacgaagatattttatatttagaagtttttgatatttaagatgtggttatttgttagtttttgagtagtatttgggataagttgtttataaggtcgattttgtttttggaaaaagttgttgtaaataaggttaaataattatagggtataagggagttgaagtatattttagttttttgatttttgtttttggtgggtatatttggttggtttagttatttttaatatttgtttttaaaaaaagtagatggaaataaaattttattgagaatattttttaaatttttaagattatattatgtttgtttgtaaggttgtttgattttggagagatggttttatttttgggaaattaaatattatgtgttgagtttttggtaaagataaataggatttcgtggggttgaatttggtttcgtggtttaagattgttttatttggttatagtaatggtaaatataggtagttacgattttagttgtattgtgcgtttttgggagggttggttttatgggttgttatattgataggtatattggttttttgcgtttgtggttttttagttttattagtaaaaaaaagataaaaatgagtatgattttttaatggatgtttatttataaatagtttatttgttttgtgtgttgtaaattattttaaaaggattgggttagaaagatgatgttgatgtttttttaatgttttagtgatttatttttgtatttttagaaaggggacgtttttttttttatggattttgcgttagatgtttgtgaagatttgtagggagatacgatgcggttggagttgatagatttagggaataaatttttttagatgtttaaagaaaagagaaagtatagattatttaggatatagatagtggtttagtattgttaagatgtggtgtgagggaggagagagggttaggattttggatttgattttgtagattggagttagagatgaatttttattaggagaatgatttatttaggtttgagtgtttaattgttttggagatagaggttggaggaagtaggttagattagagattagtgtttttgagagatgatagtggtttaaggtgatttcgatgggattgggatggagaggaagagtagatgggaagttttttttttgtttgttttaggtggaattgttaaattttagagattaaatagagttaggattaaggagaaatatttgtgattattttgaaatgttgatttttattgaggaaatcgagtgaaaaatttattttggtgggtaaggggaggaatattgggttttaggtttgtggagaaaagggataaaagggttaggaaaatttttgataggtttatttttttaggtgaaatttgagaaaaatttgattttgttttatttattttaatattttgcgtttttagtgtgattgacgtgaatgaatattatttgaattaagtttgaattaaaataaagtttattatttatttagtttattatttttaatatttattgggaattagtagtagaggtttttagattttagtgtatttagagttatttggaggtttttttatgaaaagattatttagttttgtttttagaatttttgattttaagtttggggtagtttgagaagttatatttttaaagagtttttggatgatgatgatgttggtttagggattatattttgagaattattgttttttagtttttttgttgttttttttttgagtgatttatatggaaggaagttaggcgtcgttttgtattttgtagtttgaattttggaatagtgtttgtttatagaggagttagatttgaatttaggattgagtgtttagtttttaaataaatattttttgtttgttgtaggtgtttagtaaatgtgtgtggaggaataaagcgtaaatgagagtggtttttttagtgtaaaattatttagttttttgatttttttttatttggttaatttttattttaagagttatttatatggttaaagaatttattaaataaaatatttttggagttattttgattatttttaagttttttttttttatatttttattagtttgtaggtttagtgaatattttttttaggttaaagggtttatttttaaaattttatttattatatacgtttagtttagtattttgtaagatgagttaggtagaggtgaaaaagtttttttttgtttttgtatttttggatacggaaataggcgtgaacgttgttgaacgtggattttgtagtgagtaagagttgtttgttagtgattgaaggtcgtggtgtgttgtttgtaggaaagtgttttattattttatattttttatttgtatgtggggaatagatagttatggaagaaaagagatttgtttaaattaaaatagggggagttatagttaagataagaattggtttggttattggtttttatcgttttggattattgttatttttgagtatggataagttgattgtagagagttttaaaggttaaaaatataattggtatattaaaaaaaaagtagagaaataaggtgaatatgattatgattgttaagatagttttaggggaggtgttaaataagtttttaaaaattgagtaaagtattttttatttgatattaaatggataataataatgttaggtggtattaaatgtggtttagattaatattaaatagttatttttttattggaagaaaaatgaggtaatttaatgatgattaagggaaattgtgaattgtttattattgaagataggtttggagtggatcgtttttatggtttggagggatgttttttgttttgttttagtgttggcgtgagaatagatgatttattagtttagagtcggttgtgtggttttgaaaataatggaaagtaatgatatatggattttttaaagtaaagatgttttttaaaaagagattaataaatagtgtatagaattgtttggttgaaggtttgggtgtagttattggtgtttgttaattgagtttttttttattgtgggattattgtataaatttgattttagattttttttattgatgtgattttagtagttttgtgaaaagagaataggatagttttatgtttttaatattgttttttaaatttttaagagtgttttgattttttggtggatatcgtttattgaatttagtttgttttgaagtggttttatgttgataggatagttatatttttatattttttggggtagttgtagggatttaattggatttagagtaatttatatgtgattgtttttcgaaatcgtgtttttatttttgtaggtagtagtatagggatgttttagagttggtgcgtttttcgagtttatacgagtttatttggtagtacgaagtggttataggtacggtagttgtttagtttttttgtttagtttgggttttaggattcgtatttttttggatgtattatgagggtttttgtttttttttttgtggttttaggttgagtgtgttttgagttttattaattatgttaagaagaaaaaatatattttttataagtttggtgggatggggagtaaattgagtgttagagtttttaaatttaagaaattgatttagtaaatttggttaaattgtggaattattatttgaggttattaaaaaaataaagtaaataaagatagggtgcgtaattttagttttttgttttgatttgaattaataatggaaatttttttttttttttattgtaggtgttttttttattatagttagttgtagtttttttttgggagattgttaagtgttgttagtttatatgcgttatttaattagtggaagttttttgttttttttttatttttgataataatcgtagaggggtagtgtttttagggatttaggtgggttgagtttcgtttgatggtgtttttgtgtttatttatttttttaagtgaaatgatttagattttagaaatattggaatagttggtagttgttgtagattttttttagtagaattaattaatgttggtttgatgttaggtacgtataagtttgattttatttgattttgttattttaaatattttaatgtaatttattttttaattagg

SEQ ID NO: 14 - DNA, 10286 bp, Artificial Sequence
  chemically treated genomic DNA (Homo sapiens)
tttagttaaaaaataaattgtattaaaatatttgaaatgataggattaaatgagattaaatttgtacgtatttaatattaggttaatattaattgattttgttgagaaaagtttatagtaattgttaattgttttaatgtttttgaagtttaaattattttatttagaaaggtaagtaagtatagaagtattattaggcgaaatttagtttatttggatttttgagggtattgtttttttgcgattgttattaaaaatgggaggaaaataaaagatttttattaattaggtggcgtatgtgaattaatagtatttgataattttttagggaggagttgtagttgattgtagtaggagagatatttgtaatgaaaggggggaaaagtttttattgttggtttaagttaaaatagaaggttggggttgcgtattttgtttttatttgttttatttttttaatgattttaaatgataattttatagtttaattaaatttattgagttagttttttgaatttaggagttttgatatttaatttgttttttattttattaagtttgtaaaaagtgtgttttttttttttgatataattagtaaaatttaaaatatatttaatttgaaattataaggaaagaaatagaagtttttatgatgtatttaaggaagtgcgggttttgggatttaggttggataaaggagttgagtagttgtcgtgtttgtggttatttcgtgttattaaatgagttcgtgtgagttcggaggacgtattagttttgaagtatttttgtgttgttgtttgtagaaatgaaggtacggtttcgaaaagtagttatatgtggattattttgaatttaattaagtttttatagttgttttaagaagtgtaaaagtgtgattattttattaatatgaggttattttaagataaattaagtttagtgaacggtgtttattaaggaattagggtatttttagaaatttagaaagtagtgttaggaatataaaattattttgttttttttttataaaattgttaaaattatattagtggaaaaaatttggagttagatttatgtagtgattttataatgagggaaagtttagttagtaaatattagtagttatatttaaatttttagttaggtaattttgtatattgtttattggtttttttttaaaaaatatttttgttttgaaaagtttatgtgttattattttttattgtttttaaagttatatagtcgattttgagttagtaggttatttgtttttacgttaatattaaggtaagataaaaagtatttttttaaattatgagggcgatttattttaagtttatttttagtaatggatagtttataattttttttggttattattaggttgttttattttttttttagtagaaaagtggttgtttagtattaatttgagttatatttagtgttatttaatattattattatttatttggtgttaagtgagaggtgttttatttaatttttaagaatttgtttaatattttttttgagattgttttaataattataattatgtttattttatttttttattttttttttaatatattaattatatttttagtttttaaagttttttatagttaatttgtttatgtttagagatagtaatgatttaaagcggtagagattagtgattaggttagtttttgttttggttgtggttttttttattttagtttgggtaaatttttttttttttatggttgtttgttttttatatgtaaatgagggatgtggaatagtaagatatttttttatagataatatattacgatttttagttattaataaatagtttttatttattatagggtttacgtttagtaacgtttacgtttgttttcgtatttaaagatataggaatagggaagggtttttttatttttgtttgatttattttgtaaggtattaggttgaacgtgtgtggtaggtgaggttttaaaggtaagttttttggtttgaaaagagtatttattgaatttataaattggtgaaaatgtaagaaagagaaatttggagataattaaaataattttaagaatgttttgtttagtaagttttttaattatataaatagtttttaaagtgaagattaattaagtaaaaggggattaaagagttaagtgattttatattgaaaaggttatttttatttacgttttgtttttttatatatatttattgaatatttataataggtaaaaagtgtttatttgaaagttggatatttagttttaaatttaagtttggtttttttgtggataaatattattttaaagtttaggttataggatgtagggcggcgtttggtttttttttatgtgaattatttaaggaggaaatagtaggaaagttgaagagtagtggtttttaaagtgtggtttttggattagtattattattatttaggaattttttagaaatgtaattttttaggttgttttagatttagaattaggagttttaagaatagagttgagtaatttttttataaggagatttttaagtaattttgaatatattgaagtttgagggtttttgttgttgatttttaatgaatattgagaatggtggattaagtgggtaataggttttgttttaatttaaatttaatttaagtaatgtttatttacgttagttatattgaaagcgtagaatgttagaatgagtaaaataaaattaaattttttttaagttttatttgggaaaataaatttattaagaatttttttaatttttttgttttttttttttatagatttagaatttaatatttttttttttgtttattaaaataaattttttattcgatttttttaatgaaggttaatattttaaaatagttatagatgtttttttttggttttaattttgtttagtttttgggatttgataattttatttaaaataaataaaaaaaaaattttttatttattttttttttttattttaattttatcgaaattattttaggttattattattttttagggatattggtttttggtttagtttgttttttttaatttttgtttttagagtaattgaatatttaaatttgagtgagttatttttttggtgaaaatttatttttggttttagtttataggattaaatttaaggttttgattttttttttttttttatattatattttgatagtattaaattattatttgtattttaaatggtttgtgtttttttttttttttgggtatttgggaaaatttgttttttaggtttgttaattttagtcgtatcgtgtttttttgtagatttttataagtatttagcgtagggtttatgaggaaggggacgttttttttttgggagtatagaagtgggttattggagtattagaagaatattaatattatttttttaatttaatttttttgaagtgatttataatatataaaataaatagattatttgtaaatgaatatttattaggaggttatgtttatttttgttttttttttattgatagagttagaaagttataaacgtaggaggttagtgtatttattaatataataatttatggaattaatttttttaagaacgtataatatagttggaatcgtggttatttgtatttattattattgtgattaagtgaggtaattttagattacgagattaaatttagttttacgaggttttatttgtttttattaggggtttagtatatagtgtttaattttttagggatgaaattatttttttaagattagatagttttgtagatagatatgatgtgattttgagaatttaaaggatatttttaatgaagttttgtttttatttattttttttaaaagtaggtattaaaaataattgaattagttaagtgtgtttattaaaagtaggaattaagaagttgaaatatgttttagtttttttgtattttgtaattatttagttttgtttatagtaattttttttagaagtagaatcgattttatgaatagtttattttaaatattatttaagggttaatagatgattatattttaaatattaagagtttttaggtgtagaatgttttcgtaaagtaagtttttataggatttttttttaaaattttttttgggagttatatttttttgggagaagtttgttttaagtgataatttatttatataagtagttaattttgatataattattaattttggtgttatttattaatattgagatttttttaaattttatatattttaggatgttagattatagtataaattttaaataagaggaaaatttaatacgtaaatttgcggaagagaagtaatatattagttgttttggaaaatattttttttttttcgcgatatatgtatttttatttttcgtatttggttattttcgttggttgtcggttttgtttcgttttttttaattatgtttgcgaagtgttttattttttttttattcgattcgtaggtgttgcgtgtttttttaaattacgtttaatagtaaagtgtaggatattttaatagttttataaagaagtaaaatattatttttgtaaagttatgtatttaaaaattagttgttttttttattttattgattagtttttgaatttttgaatagattttcgattatcgtaagttgagtttttttagaagattaggattttaaagttcgattcggtttattttttgttattttgggaatattttttatttttaggggttaatgcgagtttggcgggttatagcgttcgttttatcgagagggggtcgggtttcgtagggggtatttttcggtcgttcgcgcgttttcggttcgtcgcgaggggcgtttcgggtagcgcgggggtcgacgggcggcgtcgtagcgttgggtcgcggttaggaatgagtttagcgttttcgtcgggtgttgtcggtaggttgtattagacgtcgcgcggcgtcgtcgttcgcgtttttagtttcgcgtggttttttcgggttagcgggtcgtttggggtcggggttgggttttttcgagtcgggttcgtatttagtcgagcggtcggcgtcgtcgcggttttttttttttcgtttttagggcgttcgtcgtagtttttttatttgtttttttagttcgtttgtttttaggcggtttttatttcgagcggtttcgcgcggtgcggttcgagtcgatttaggttttatagttcgcgagttagcgaggaggagcgacggttacgaaatcggtagttttcgttcgtttcgtagtcgcggttatcggttttttttgttcgtcggggtcgcgcgcgtcgtcgtcgttatttcggttaatgggagcgtcggtttgtcggaggtatcgttttttttcgcgacgggtagtttagtcgattaatcgtgggtaggttggcggcgggaggcgggtttacggtgggggagtgggtttcgcgcggttggttcggcgggtgtggcgggagtagggagttgtttgttgcggcgttcgcggtttttaggtagttcgttcgggttggcggcggtttagtgttgtggacgatttaagttcgagtcggaggttgaaaagtcgttattttgtggaggttagacgtgtttttggaagtattttttgaggtggttttgtgaattatcggcgattgttttggtttcgtcgcgttttttggaagttttcgcggcgttttttatagagtttttgcgaacggaacgtttcgtaggcgggcgggttttgtcgtcgtaaaaagagtggaggttgacgcggtggttttcgtttataattttagcgtcgagggaggtcgaggcgggagaatggtttgagtttaggcgttggagaattagtttggataatatagcgagattttattttagttattaatttttaaaaaatcgaatgaatttagatgttttatatataggattagtattgatgttatatgggtgaaatttatgtgttgtaggttgtgttttgttgttagggtgagatgaagtgaattttttaaaatgattttttttgggtgttttttaggtgtatgggtgcgaggtgatttttgaaaataagtagcgatttagtgtgatttaaaattcgttaggagaattcgaaagcgttttttttttttttttttttgagacggagtttcgttttgtcgtttaggttggagtgtagtggcgtaatttcggtttattgtaagtttcgtttttcgggtttacgttatttttttgttttagttttttaagtagttgggattataggcgttcgttattacgttcggttaattttttgtatttttttagtagagacggggttttatcgttttagtcgggatggtttcgattttttgatttcgtgattcgttcgtttcggttttttaaagtgttgggattataggcgtgagttatcgcgtttggtttcgaaagcgttttaatattaggaagtagtagttcgttgggcggagggtagaattcgtttgataggtttaattgttttttttttagtaacgcgtatcgtttaaataattgaggttttgaaagaggaaatgtttttttagcgtttatggaatcggttcgtttcgtaagattgtttcgaggaattagtaagatgataaagtaataaataaaaattaaaaggggttataacggtgtaataatgggttgggcgcggtggtttaggtttgtaattttagtattttgcgaggtcgaggtaggttgattattttaggtcgggaattagagattagtttgggtaatatggaaaaattttatttttattaaaaatatagaagattagtcgggtgtggtggcgttgtgtttgtggttttagttattttggagtttgagatgggaggatggtttgagtttgagaggcggaggttgtagtgagttgagattgagttattgtattttagtttgagttatagaatgagatttttgtttttaaaaaaaaaaaaataggtaataatgtttatagatgtatatttaggagaataagtgttattgaaataagtgtgtttttttacgttggtttttagtatttttagtttaaatttttttttttttttttttttgagacgattttgttgtgttgttttagttggagtgtaatggtattgttatagtttgattatagtttattgtagtttcgattttttgggtttaagttatttttttattttagttttttaagtaggtgggattataggtatgtattattatatttagttaattttttaaaaatgttttgtagagataaggttttattatattgtttattttggttttaaatttttgggtttaagtgatttttttgtttcggttttttagattgttgggattaagggtgtgagtaattaagttttgtttgaatttgttttgattaagattttagtattattaaaataggattgtgatttattgtttataaaattataattttattttgaatattttttaattatttaaaaaatgtgtaagggggttagatatagtggtttacgtttgtaattttagtattttgggaggtcgaggtaggcggattatttgaggttaggagtttgagattattttggttaatatggtggaattttgtttttattaaaaatataaaaattagttaggcgtggtggcgggtgtttgtaattttagttattcgggagtttgaggtagaagaattgtttgaattcgggaggtaaatgttggtagtgagttgagattacgttattgtattttagtttgggtgatagtaagattttattttaaaaataaaaaaataaaaataaaaaaggaaagaaaagaaaaaagaaaaatgtgtaaggggaaaaaaaagaatttgtataggtatatttagttattttttggtttgtaaatcgttttgttaagttgttttagtattttttgtatttgtgtttgggtaggtttttttatatatttagtaagtttagttagtgtttaggatattcgggtatttattttttttttagttggtagttggtagttttttttttatttagtttataagtatgtatttggtgttaattatgtattaagtcgtaggttaagtgttggagatttagtaatgagtaagataaatatatagttattgtttatatggaatttatatttatagttaggtagataggcgtttggtaattatataatttttttttttgttatttatgttggagtgtagtggggtaagtatggtttattgtagtttggattttttgggtttaggtgatttttttattttagttttttaagtaattgggattataaggtatgcgttattatgtttggttaatttttgtattttttgtagtaatagggttttattatgttgtttaggttggtttcgaatagttgaggttaagtgatgtatttatttcggttttttaaagtgttaggattataggtatgagttattttttttggtttataattttttaattattatttttatagatattataagaaagtagtataagacgttgtgagaaattagaagcgaattagatttagtttgatgggttcggggaagtttgaaaaattgataggatttggttaggtaatatagaggacgtgggtgtagtagttatagggaatttttgttcggggttttgtgatgggagaaatttaaggttaaagtggttgaaagtaaagtggagattaataagataggtagggttatgtgggtttaagaaatatttagatttttattttaagagatagaagttttcgaaagatttgttttttataaggaaacgagagtttggtgaagttttggaggtttattatgtagttttttttataagttatagggatttaagttattatagtaaaagaaaaattttttgtatatttttttgttttatagtaattaatatatattttataaatttaaagattgagtagtttttatagtattttgggaggtcgaggtgagaggattatttgaagttaggagtttaagattagtttgggtaatatagtgagattttttatttttatttaatttaaaaaaatttaaaataaaaaaattttttaaaggatttgggaagtaggttgttgtatttattgaatattgtagttatttgatagttattatgattaattatattagttatttaagagatatgaatattagtgtttatagttttatcgtttgttagatgtgtagttttggttaaattatttaatttttttgttatttgtaaatggagaagataatagtgtcgttttgaggattaaaggaattagtgtgttagatttttaaaatagtgtttgtttggtattttaaaagtattagttatatggttggttagagtggtttatttttgtaattttattattttgggaggttaaagttggagtgtaatggtatgagtatagtttattgtagttttgaatttttgggtttatgtagtttttttattttagttttttaagtagttaggattatagacgtgtattattatatttggtttatttttaaaattttttgagagatgaaatatttttagagatggagttttattatgttgtttcggttagttttaaatttttgggtttatgatttttttatttcggttttttaaagtattgggtgtgatgggtggtatgtgtttatggttttagttatttaggaggttgaggtgggaggattatatgagttcgggaggtagagattgtagtgagtttagatcggtttgggaaattaagcgagatttagttttaaaaaataaaaaaagtattagttattattattacgatgtttatatatgaattataaataaattgtatttatagaattatagtagattaaaatatattgtaaaatgaggttaagttgtgtttatattgttttgttgatttaggtattaaatatataaaatattgaaggttatgatgttgattttatgttgtattttaaaaggtgttatttttagagtagttttttagttattatattttattttatttgtttttataaggtagagtggaggaataatttagtaatttgatttttttgtatttgaaagttagattaatagaagtttattatgtaaattgaaataaattaatgtatatttggaaagtttttgaaaaattaaatagttaagttaattatttttgataggagatttagattgtatttgtaatatttgagagttgggaaaatgttcgttagatttgagttttagttgatgttttgtagtatgttggtgataatatgattattaattattttgtattggtaaaggttttttggttgga

SEQ ID NO: 15 - DNA, 6046 bp, Artificial Sequence
  chemically treated genomic DNA (Homo sapiens)
  unsure (574)
gtgtggttggagtggggagagtaaaggggagggatagtggtaggaggtaaggttagagtataaataaagggtaagattatgtgaggtttgggagataattgaaagacgttgggttttgttttgagagaaatttagagggtgggggtgaaggtgtggtattgggggttttgagagaggagtgatatgatttgatatatttttatagaattatttaaattgttgtgttgagaatagattggtagtgggaggtgggtaagggtggaaatattgagattagtttagtgttagatgatgatatttcggattatggtagttgaagcgtaagttgtgataaattttttatagtttgaaatttttttaaggtggttttgatagaatttttaggtgagaagttgagtagtatggttttagagtttgtatttggataattggaaggatggatttgttaataattgagaatagaaaattgttgattgagtagattttgaggggaagagtatgaatttggtattagatattttaagtttgttataaatattagatatttaatatgggaggaattaaggtatatgtntgttgttaagattggttttttagagtaggagaaaatgataagtaggatagagagtgagaaggagaggattgtatttagtgtatatatggagagtttttagagtggaaaatatatagatgtttataaagttatagtttggaaggcgagtatgtaagtataaatgtatatagtgagtagttagattgataggaattagggtaaagttttttttggaagtttttatttttatagtgaaataaagagtgttttgtttgaaggaattaatgaatttttttttatttttttgtttaaaattttttataggtttttttttatttttgagaataagatttaaatattttattatagtttataaggttttatgggttttggatttggatttgtttatttttttttattgttataaatgttttagttatagggtttttttttttgtgttttagatagatgataaattcgattaagttttggtttttttgatttatttgtttttttgtttggtacgtttttttttttgtttttttaagtttggtttattttttttatataggttttattttaaaggttatttttttaggttttttttgaatattttatttaaaataaattttttttttaatatattattttattatatatttgttatgtattgtttgttgttttttataagaatgtgttttataagaaattagtatttttaatttattttattattttttttttgttttttgattttattaattattatattatgtgtgtgtgtgtgtgtgtgtgtgtgtgtgtgtgtgtgtgtgtgtagagagagagagagagagattgagatttttttgtattatttattttttttaagagaatagtaattttataataataggtattgtgtttattttatttattgttgtgttttttgattttagaatcgtatttggtatataatagttgtttaatgaatattttttgatgaataatttggaaagttagatgaaaaaattggatagagagtatataatagagagtttggtatatagtaaatttttaataaatgttatttgttgtgatgataaaaaaagatagttatagtaacgattataagtataattatgaaaggttgatgatttttttttattcgtgaattaatttttttttgttttattagaaattttgattaattatatttttttttttttttataggttttttgtttttagttgttttatatttgtttataattaaaataaaaataatagttaaaatatattttttttaattttgtatttttttattagatataattaagtatttttatagtttagtaataaaaaagagttgtttatattattttatagttagttaattaaaataaattttgaatgaatagatttatttttttttattgtttttatttataaattagtttttttaaattgaaagaaattatttttatttaatttagtttattatttaatttagtttttattttgtaaggaaattaggtatattttgtgtatttttttaaaaattatgtatgtatatttagatatattttgtgtatataatcgtgtattttgaattttttttaataaatgaaatattttggatagttttttaaagtatatataaaaagttaggttaggtacgatggtttatgtttgtaattttagtattttgggaggttaaggaaggaggattgtttgagtttaggagtttaagatttgtttaggtaatattgtgagattttattttttattttaatttttttattatttcgtttttataaaaaaatttaaaaattatttgggtttgtgatgtgtttgtaatttaagttatttaggaggttaaggtgggaattttatttgggttgaggttaggagttgagtttgtagtgagttgtgtttagtttattgtattttagtttaggtgataaagtaagaatttatgtttatttaaaaaaaaaaaaaaaaaaaaacgagagagagagaagaaagggaaattaagtattatttttgggaaaaaattattgtatttagaatagtttttttttttagttaataaaagtaataaattaggttaggagcggtggtttacgtttttaattttagtatttttggagatcgaggtaagtggattatttgaggttaggattttgagattagttttgttaatatggcgatcgcgttgttttattaaaaatataaaaattatttgggcgtggtggcgggtgtttgtaattttagttattggggaggttgaggtaggagaattatttgaattcgggaggtagaggttgtcgtgagtcgatatcgtattattgtattttagtttgggtgatagaggaaggttttatttttaaaaaaaaataaaataaaataaaaaatagaaaagaaaagaaagaaatggttgaataaattataatgttgttatataattgaatattatgtagttaatataaaaggtagatttatatattgatttgttagtgtaaaaagtaaattttagattaattatagaataattttatttttgaaaatatgaaaatatttggttatttatatagatttattgtatatatttaagaaatataaatttaattaatatagattattttagggaagatgaaatttgatgattgggtaatagaaggaatatttattaggtaatttagataatttttaaggtgaaattatagatgattttttttgttattttttagtatttttttgaaataagagagtaattaaaataaattttgaatgaatagatttatttttttttattgtttttatttataaattagtttttttaaattgaaagaaattatttttatttaatttagtttattatttaatttagtttttattttgtaaggaaattaggtatattttgtgtatttttttaaaaattatgtatgtatatttagatatattttgtgtatataatcgtgtattttgaattttttttaataaatgaaatattttggatagttttttaaagtatatataaaaagttaggttaggtacgatggtttatgtttgtaattttagtattttgggaggttaaggtaaggaggattgtttgagtttaggagtttaagatttgtttaggtaatattgtgagattttattttttattttaatttttttattatttcgtttttataaaaaaatttaaaaattatttgggtttgtgatgtgtttgtaatttaagttatttaggaggttaaggtgggaattttatttgggttgaggttaggagttgagtttgtagtgagttgtgtttagtttattgtattttagtttaggtgataaagtaagaatttatgtttatttaaaaaaaaaaaaaaaaaaaaaagagagagagagaagaaagggaaaataagtattatttttgggaaaaaattattgtatttagaatagtttttttttttagttaataaaagtaataaattaggttaggagcggtggtttacgtttttaattttagtatttttggagatcgaggtaagtggattatttgaggttaggattttgagattagttttgttaatatggcgaagtttcgtttttattaaaaatataaaaattatttgggcgtggtggcgggtattttgtaattttagttattggggaggttgaggtaggagaattatttgaatgtaggaggtggaggttgtaatgagtagagataagtattattgtattttagtttggggtgatagagcgagatttcgtttttaaaaaaaagaagaaaaaaaaagtattaatttattatttaatgagttttttagttttcggtatttattttttttaatttaatttttgaggaagttatagttaatggaaacgagttatagagagagagaaataggagaaaagtttaaatttagattttttaaggcgtataataggtttgttacgtttttggattggatagcgaattttaatttttgttgttgaaagtttattttaaattgttggtgtagtttttttaaaagacggtaattttgtttgggtagtgaaaaatatatgtatttttatttagtttcgtttataggttttaaattttttaaggatggggtggaggatgacgttcgttagtttttggtagataatagtattttggtattttaggattattattttttgtttatttttgggagttttttttttcggttttttttttcgattttttgttgggttttttaaatttttttttttgtttagtagtggttacgtcgttcgttttgcgtttttcgcgttgtttcgtacgtggaatggtttatgacgttacgaggttacggtttaattagatgcggcgtttgggaaattttaaatttaaaggcggggcggtttgtgagttttgaagtgtcggtcgcggagggttttggttatttttttgggattagtttagtttgataggatggcggaggaaggagtcgtggtcgtttgcgtgcgagtgcggtcgttgaatagtaggtaggggggttatattacggttcggtgttcgttgggtttgcggcgtcgttttgagtcggaggggcgaggtttacgatgtttttaggagtcgttgtttttcggttttgttgtttagtgattcggttgttggttatcgttttagggtttgtaaagtgataggggaggatcggagatttagaagatattttttagttgcgagatttatttaaatttaatttagtttcgttgatatatagatttttttttttgtgttgttttgttttgcggtatttgtttttttttgttttatttttcgtttagagaagtcgtatgggatcgtgtttttttggtttttattatagttagttattttatatttaattgttgtttttagattttttgaagataagggttagtttgttttgttatattatatttaatcgttatttaagattattttataaatatttattaatttttttttagtgattttgtataatatagatattttcgttattgtttagtggtttttttattttaatgggacgagatagaaagtaaagttgaaaatgtaggatgttaagtggtgatatgtaggtaataagtgttagggagaaaaagtaggaagaggaataaatgaaatcggtttgttttattagtttttggttttcgattcgaaatgttaatattttgtgtgtgtgagaaatttttattgaatacggggtttaataaatgtaaatattaagattaggaattttttatttttgaggagtttattatttaatgttttaaacggttatataaagaaattattaggatattttttgataagtgttatgatgggtaggtagagaatgtttgttagaggagttattagtttattagagacgaaagtttttcgtggggtgaattggtgttagaaaagttttgacgttttttatgagtgaaataatttttatgttatttaatggaaagggaagttagagtattttaggtatagagaggttatatttgttatttg

SEQ ID NO: 16 - DNA, 6046 bp, Artificial Sequence
  chemically treated genomic DNA (Homo sapiens)
  unsure (5473)
taaatgatagatgtaatttttttgtgtttggaatattttgatttttttttttattaagtaatatagggattattttatttatgaaaagcgttaagatttttttgatattagtttattttacgggaagttttcgtttttgatgggttaataatttttttagtaaatattttttatttgtttattataatatttgttaaaaggtattttaatggtttttttatgtagtcgtttaaggtattagataatgagttttttaaaaataggaaatttttgattttggtatttgtatttattaaatttcgtgtttaataaaaattttttatatatataaagtgttagtatttcgggtcgagggttagaagttagtgaagtaaatcgattttatttatttttttttttgttttttttttttagtatttattatttatatattattatttaatattttatatttttaattttattttttgtttcgttttattagaatggaagagttattgggtaatgacgggagtgtttgtgttgtataaagttattaaaaaaaaattgataaatatttgtagaatgattttgagtgacgattgaatgtaatgtgataagatagattagtttttgtttttagagggtttggagatagtagttaggtgtaaaatgattaattgtgatgagggttaggaaggtacggttttatacgatttttttaggcggggaatggggtagggaggagtagatgtcgtaaggtagagtagtatagaagggaaggtttgtatgttagcgagattgagttaaatttaagtgaatttcgtagttggaaagtattttttagattttcgatttttttttgttattttatagattttgaaacgatggttagtagtcgagttattagatagtagagtcgggaagtagcggtttttggaaatatcgtaggtttcgttttttcggtttagggcggcgtcgtaggtttagcgggtatcgggtcgtggtgtggtttttttatttgttgtttagcggtcgtattcgtacgtagacggttacggttttttttttcgttattttattaggttgaattggttttaggaaaatggttaggatttttcgcggtcggtattttagggtttataggtcgtttcgtttttaaatttaaaattttttaaacgtcgtatttgattgagtcgtggtttcgtgacgttatgggttattttacgtgcggagtagcgcgggggacgtaaggcgggcggcgtgattattgttaaataggagaggggatttaaagggtttagtagagagtcggaggagagggtcgaagggaggggtttttaggagtgggtagagagtggtggttttggaatattagaatattattatttgttaaaagttagcgaacgttattttttattttatttttaaaaagtttggaatttgtagacgaaattaggtagagatatatgtattttttattatttaaatagaattgtcgttttttaaagaaattgtattaatagtttaaaataaatttttaatagtaagagttgaaattcgttgtttagtttagaaacgtgataagtttgttgtgcgttttagaaaatttgagtttaggttttttttttgtttttttttttttgtaattcgtttttattagttgtggtttttttagaggttgaattagggaaaataaatatcgaggattgaaaaatttattgagtaatgggttgatattttttttttttttttttttttggaaacggagtttcgttttgttattttaggttggagtgtagtggtgtttatttttgtttattgtagtttttattttttgtatttaagtgatttttttgttttagtttttttagtagttgggattataaggtgttcgttattacgtttaggtaatttttgtatttttagtagagacggggtttcgttatgttggtaaggttggttttaaagttttgattttaggtgatttatttgtttcggtttttaaaagtgttgggattaaaggcgtgagttatcgtttttggtttggtttgttatttttattaattaagagggaaagttattttaaatatagtgatttttttttaaaaataatgtttattttttttttttttttttttttttttttttttttttttttttttttaaataaatatgagtttttgttttgttatttaggttagagtgtagtaggttgaatatagtttattgtaggtttaatttttggttttagtttaagtggggtttttattttaattttttgagtagtttggattataggtatattataagtttagataatttttaaatttttttgtagagacggggtggtggggggattagggtagggagtggggttttatagtgttgtttaggtaggttttgaatttttaggtttaagtaattttttttgttttggttttttaaagtgttgggattataagtatgagttatcgtgtttggtttagttttttatgtgtattttagaaagttatttaagatgttttatttattaagagaaatttaaggtgtacggttatgtatatagaatatgtttggatatatatatataatttttggaaagatatatagaatatgtttaatttttttgtagagtgaggattgagttagatggtagattgagttagatgaaagtagttttttttaatttaaagaaattagtttatagataagaatagtaaagaaaaatgagtttatttatttaagatttgttttggttatttttttattttagaaaaatgttagaaaataataaaaagaattatttgtaattttattttaaaaattatttaaattgtttagtgaatgttttttttattatttagttattaaattttattttttttaaggtaatttatgttaattaaatttatattttttgaatatatgtaataaatttatgtggataattagatgtttttatatttttaagaataagattattttgtaattgatttaaaatttgttttttatattaataaattaatatatagatttgttttttatattggttgtataatatttaattatatggtagtattatagtttatttaattatttttttttttttttttttgttttttgttttgttttgtttttttttggagatggagtttttttttgttatttaggttggagtgtagtggtgcgatatcggtttacggtaatttttgtttttcgggtttaagtgatttttttgttttagtttttttagtagttgggattataggtattcgttattacgtttaggtaatttttgtatttttagtagagtagcgcggtcgttatgttggtaaggttggttttaaagttttgattttaggtgatttatttgtttcggtttttaaaagtgttgggattaaaggcgtgagttatcgtttttggtttggtttgttatttttattaattaagagggaaagttattttaaatatagtgatttttttttaaaaataatgtttaattttttttttttttttttttttcgtttttttttttttttttttttaaataaatatgagtttttgttttgttatttaggttagagtgtagtaggttgaatatagtttattgtaggtttaatttttggttttagtttaagtggggtttttattttaattttttgagtagtttggattataggtatattataagtttagataatttttaaatttttttgtagagacggggtggtggggggattagggtagggagtggggttttatagtgttgtttaggtaggttttgaatttttaggtttaagtaattttttttttttggttttttaaagtgttgggattataagtatgagttatcgtgtttggtttagttttttatgtgtattttagaaagttatttaagatgttttatttattaagagaaatttaaggtgtacggttatgtatatagaatatgtttggatatatatatataatttttggaaagatatatagaatatgtttaatttttttgtagagtgaggattgagttagatggtagattgagttagatgaaagtagttttttttaatttaaagaaattagtttatagataagaatagtaaagaaaaatgagtttatttatttaagatttgttttggttaattagttgtgaggtagtataaataatttttttttattgttagattgtaaagatatttggttgtatttagtaagaaaatatagagttaaggaaggtatattttaattgttgtttttgttttaattgtgggtaaatatgagatagttgaaggtaaggaatttatgaagaagaagggagatgtgattaattaaaatttttaatgagataagaggagattggtttacgagtaaagagaagttattagttttttatagttgtgtttatgatcgttgttatgattgtttttttttattattatagtaggtgatatttattgaagatttattatatgttaggttttttattatatgttttttatttaatttttttatttgattttttaaattgtttattaagaaatatttattgaataattgttatgtgttagatacggttttaaggttaggaagtataatagtaaatagaatagatatagtatttgttgttgtagagttgttatttttttagaggagatgggtaatatagaaaaattttagtttttttttttttttttttatatatatatatatatatatatatatatatatatatatatatatataatgtaatgattaataggattaggagatagagagagagtgataaggtgggttaagagtgttagttttttatgaaatatatttttgtgggaagtagtagataatatataataaatatatagtaaaataatgtgttgggaggaaggtttattttagatgagatgtttaagaaagatttgaggaggtgatttttgaagtgaaatttatgtgagaagagtgagttagatttgggaggataagagaaagggcgtattagatagaggaataagtaagttaaagaagttaaggtttgatcgagtttgttatttgtttgagatataaaggggagggttttgtgattgaagtatttgtggtaatggagagaggtaggtaggtttaggtttaggatttatggggttttgtgggttgtgataaaatgtttggattttatttttaagggtgaggggaagtttatggagggttttaagtaagggggtaaaaagggatttattaatttttttaaataagatattttttattttattatgaaaatagaagtttttagaaaagattttgttttaatttttgttaatttggttatttattatgtgtatttgtgtttgtatattcgttttttagattgtaattttataaatatttgtgtgttttttattttggaaattttttatgtgtgtattggatatagtttttttttttttattttttgttttgtttgttatttttttttgttttagaaaattagttttaatagtanatatatgttttaattttttttatattgagtgtttaatatttatggtaaatttaaaatgtttaatattaaatttatgtttttttttttaaaatttgtttaattagtagttttttgtttttagttgttggtaagtttatttttttagttatttaggtgtagattttggagttatgttgtttagttttttatttgaaaattttgttagggttattttgagaaaattttagattatgaaaagtttgttataatttacgttttagttattatggttcgaaatattattatttggtattgagttaattttagtgtttttatttttgtttattttttattgttagtttgtttttaatatagtaatttgaatgattttgtgaaaatgtgttagattatgttattttttttttaagatttttagtgttatatttttatttttattttttagattttttttagaataaaatttaacgttttttagttgttttttaagttttatatgattttgttttttgtttgtgttttggttttattttttattattgttttttttttttgttttttttattttagttatat

SEQ ID NO: 17 - DNA, 5979 bp, Artificial Sequence
  chemically treated genomic DNA (Homo sapiens)
ttaagtttttatttttgttgtgggaatggtatttttagaatatgtatattattttgaaaaggaagtataaattagtgaatattaaaggggaaaaattttgttaattatttatattatgagtttgaaggttatatgtgaaatatagaaaagatttaggtttgtttgattatggaattttagattaaaatatgttttttatgtttgtagtaatttataagttattggaaaggaatatgtagagggttttgatatttaaattttatttagttttttgtaggattttgattttattttaatgtaagattgttgattttatgattttgtgtgttttttagagatatttttattgatgatgtataaatgaattttgatttagtaaggttagtttgtaggttttaaagtattttggttattgtggtatattagaatgatagttagtatttattgagatttttttatatgttaggtaataaaaattttataaaagtattttttttatagttataggaggtaggtattatttttattttatagatgaagaattgtggattttgtttttaagaaaatttttaggtttatagaattaagtttaatttttttttattttttagtaaatatagtttttataagaatttgaattttatgaaaataaatggattatttttaaatttttgatgttttagtgaatattttttttttattaataaaatttttatttttggttttggattggttttgtaggagtgtagattgattatagttttttttatgttttaagagttgttagagtttttttttgtagtatttttttttttattttttttttttattatttttaaatatatgattgtaagagtatgataaatatgttgttttttaatttttgttgttgttatataaattaatatattttgagtaattttgaaatgatattaataatgttattagattttttttggattttttgaaaaaaataatggttttagaaggaaatttggataaattttatttttgttttgtgttagaaaaatataaaatttgagttttttaaattaaggtattaagataaataaattgtatttatagatattgaaatatgattgtaatttgataatgtatttttatttttagtgttattgtttattataatagtatttatattattaattttatttagagtttgaattttgtaataatagagattgaaaataaattggtttataattaattttgatagagaatgatgtttttatttttatatttttttatagaagtatatgttttttaattttaaggaatgaataagttagatggaagatttttattgagattaggaatgaattgagtaatttagttttttttttaaagttggggagaaatgagtaaaattaaggagaaatattttgtttttgatatttattattgatgttgtgatattttttttaattaatgttttttaatatgggtggtagtattttagttaattaaatagttaagtaagtagatttttgtattgtatatagtaaatagtattttaattgttgttaaggagataaggaattatttaatgggtaaaaatgtttttatatttatttattttaaatttagttatatttgattgtatttttataaatttagatggagagttggaaaatttatagagaagattagggtttaaattttgtttttttaaattatgtttggttatgatgaatttgaattatttatttaatgataaaattatttgattttttattttttatttttttttttagttaaaattatttaagtaatggatttgtttttttatgagagatatttggtattttggtaatgaaagtgtattattttagttgtatataatttgaaaatagtattttatggtaaatttattaagttaggtagatattttgtatttttgattttttttttttttttttttttttgggggttatattttttttgtatttttagatatgtcgttaaagaaggggttatttatagtggttattttggttttttgaataaaattaatatttgttggattgaaaaattatgttatgatcgattgttttatgtgtgtatgtttttttttttttttaaattttttaagatttttttttataattagttttttttgaagaagtttggaaagttttttgtattgagatttagaatttatagtgtttttgtaatttagttttttaggaattttgaattttaatttttgtttttattttttatgtatatagtataatgatgttagtgttaaatattaaaaatttgattttttattgggatttttttatagatataaatgtatttgtggtagtataaggattttgttattttggcgtgtagttttattaaggagttgtgtgtgtgttttgtatataattttataattttatagttgaaagttgttataaaatgaaagttttgtgtatggtaggatatttttaaggtgggtggatgttttttgtttaaaagattaagatgttaatagcgttttttttttttaatttttttattaagtatttagttagtttgaagagttttaaatggattttattattgagaaattaagatggtagtttattatggggaattgaggaaaaatggattaatataagagttttgtgataatatataattaagatagggtttttttaatatggattttatgtagtgaatgaagatataggttttttatttaatataaatggatagtggatttgattttttaaagattttttttgtggatattttgatatttggagaagaaagatggtatattaatttagataatagtttttatgtttggaattttttgtagtttgatttgtatgcgtatgattttttgaaatgttaatttttaataaaatttgtaatatttaaaaattttttagtttgggtttttttttttaagtggaagtttaattaaatgtttagttttattttagtaatattttggtttttgtagttgtcgagtggtaaagtgtattgaatatgaataaagttggtaaattggaaatggtgtaatcgaaaatattttatttggtttatgaagatttacgttttttataaagttgtgtttttagatggttatttggtttaaatattgttttgtttgtgtttttatgaaatattttttaaaataatttaatgggtaataatagaatttgattttaatttgttataagattttaatgaatttgaaataaattgtttgttgttcgaaaatttaggatgagtgatatatatatatttttgaattattttgtgttgattgaaatggttttttaagttttttaatattataaatatattttgttatagaatatttatttgaatatttaaattaatgttttttattgttttattattagaggaagaagtgttggatttatgggttagggtttttggagtatttataattttttaaatttgaaattatgtgtgtaatttattttatataattttgaagtaggattaatattttgtatcgtttttattttgtataattggggatttagaataaatgaattgtattttgttatagattatttacgtttgatttttaaatgttaggtttttatttattattaattaattgatattagttttggtaattattataaaggtggtaggtattattttggtagataaaatgagtttttgattttgtttttttattttatatgagaagaataaatagtttaggttaaattgttttgtgttaattatattgtttgtgatttatgttaaatattgtagtatatatatttatggttaatatacgagtattatttgttattgattgatgtgaggtggttggtttttgttaaatttaaaaatggaattttggatattgtttttgttacgaaatttatttttgtgtgtagagtatggaattgaaatagtttggattatggattttatttagattggatattgttgattttgtttggtgtaaatttaaagtggatttttttagtgagggagagatatggttttggtagattatgttgaataaggaaagttgattggatttttttgggtgtgtgaatatgtttgtttgaatggagtgtttggtaggatattgtttttggaattagtaatttgtttttgtggattttatggttttgatatttaggagaatttgttttgtgatattattttgataatttgtaattacgtatgttttattgttaataatattgttgaaatgggtgtatatttatttgatttgaaatataagggaagtgttgggatatgtgttttttgttggatttggacgtggagttttttgggttattgatttaaaggtgatcgtgtttggattatatttttgaatttttgtttgaattagtatgggaagtaaatatattgtgattatgagaagtttttttggggggaggagtgtaatatttttaaggttatataatgggttaaagaattttgtgaaagaataaagaaaaatggatatttttgaataaaaattggttgtattaatttttgttttagtgtaatttgaatattagggaggcgtttttgagttgtaaaagttattttttttttttagtggagatggaaaatttttttttaaattttgtttttagattatttttaggtattataaagaaggaaaaatttgaatttatattatgaaattaaggttttatttttatttagtaattattttatttattgggggattaatttttaaaaagattagtatttagttgagttttagattttttaagaattattttttttttaaaatggtttgataaaatattattttttgtttagggaggaagttattttagtttaaggattgaaatatttagtagatttttagataaaaggaataaattatatttttttttggtttaaaaagggtgtttgagttagagggggttaagaagtttttttttttttttttgttggggtggtttggaggggtagggaggtgtgggggtgggggtttttaggttttttgggatggaggatttgttttttttttttttttttttttttttttttttggtggagatgaaggggtgggtttatggtatattatttgagttgtggggtaaatgtagagagtgttaattaaaggtagagtttttagagttgggaaggaggttttagatggcggttgtgttttagagagagcgcgttttgttttttgtttttgttttattttacgtaattttttttaattttcgggtagttttagggggttttcgtagttttttgttttttttagggatttattggggtcgattcgaatttttttttgggagaaaagtagtttttaggagtttttttttcgtgttttgttggaaagaagtagtcgtattgagagtttaggtcgttgttttttttagtttagaagttatggcgtatttttatttttgtgcgtttttttaatgaggttttttttttttcggatttgttttagtattaattattgttttatttttttgattagttaatatatttgagggttattttatttatttttcgttttttaacggaggattttgtttttatttttaattatttgggatttgatatttttttattagtagataggatttttggtttggatatattatatggattaggtaagtttacgattattggtgataattttaaagatttatttgtttaagtttgttttgttttttgtaaatacgagaaatttttggatgacgtaataagatatagagattgttatttgtatttagtgtgttattttgagaaagtttttttattgatagtgatgtttttattgttcggtttattttgttgtttttttttttaaggaaaaaatagaaatatttagttttttggtgtttatcgttgttgtgttataataatatcgttaatatcgttaggattttgtttttgataataaaaagtatcgatagaagtcgggattttattttttttttaatttttgatagt

SEQ ID NO: 18 - DNA, 5979 bp, Artificial Sequence
  chemically treated genomic DNA (Homo sapiens)
attgttaaaagttgaaagaaaggtaaggtttcggtttttatcgatgttttttattattaggaataaagttttgacgatgttaacgatattgttataatataataacggtaagtattaaaaaattaaatatttttattttttttttaaaagaaaaaataataggataaatcgaatagtggaagtattattattaataaggaaatttttttaaagtagtatattagatataaataataatttttgtattttattgcgttatttaagaatttttcgtatttatagaaaataaggtaaatttaaataaataaatttttaaaattattattaatgatcgtgaatttatttgatttatgtagtatgtttaaattaagagttttatttattagtagaaaaatattagattttaaataattaaaaataaaggtaaaatttttcgttaaaaaacgaaaaataaataaaataatttttaaatatgttaattggttaaaaaaataaagtaataattaatattaaaataggttcgaaagaaaaaaaattttattaggagagcgtataaaaatggaggtgcgttatggtttttaagttggaaaaaataacgatttgggtttttagtacggttgtttttttttaataaggtacgaaaagaaagtttttaaaagttgttttttttttaaaaaaaggttcgaatcgattttagtaagtttttaggaaaggtagggggttacgggggttttttgaggttgttcgaaagttagggaaagttgcgtaaagtgaggtaaaggtagggagtagagcgcgttttttttaaggtatagtcgttatttagagttttttttttagttttgagagttttgtttttgattgatattttttatatttattttataatttaggtgatgtattatagatttatttttttatttttattaaaaaaaaaaaaaggagagagagagagagagatagattttttattttagggagtttaaggatttttatttttatatttttttgtttttttagattattttaatagggggaggggggagggttttttaattttttttggtttaagtattttttttaagttagagagaaatgtaatttgttttttttgtttaaagatttgttaaatattttagtttttgagttaaaataattttttttttggataggaagtggtgttttattaagttattttgaaaaagggataatttttagagaatttaaagtttagttaagtattaatttttttaaaaattaattttttaatgggtgaaatgattgttaaataaaagtaaaattttaattttataatataaatttaagtttttttttttttatgatgtttaaaaataatttaaagataaaatttaagggggaattttttatttttattggaagaaaggggtaatttttataatttaagagcgtttttttagtgtttaagttgtattggagtaaaagttaatgtaattaatttttatttaagaatatttatttttttttgtttttttataaaattttttaatttattatataattttgaaaatattatatttttttttttaaagaaattttttataattataatatatttattttttatattgatttaggtaaaaatttaagagtatggtttaaatacgattatttttaaattagtaatttaagaaattttacgtttaaatttaatagaaaatatatattttaatattttttttatattttaaattaagtaagtatatatttattttaataatgttattaataataggatatacgtgattgtaaattattaaagtaatgttataaagtaaatttttttaaatattaaaattatgagatttatagaaataaattattaattttagaaataatattttattaagtattttatttagataagtatatttatatatttaaaaaaatttaattaattttttttatttaatataatttgttagaattatgttttttttttattgaagaaatttattttagatttatattaaataaaattaataatgtttaatttaggtaaaatttataatttaaattgttttaattttatattttatatataaagataaatttcgtagtaagaataatatttaaaattttatttttgaatttaataaagattaattattttatattagttaataataaatggtgttcgtgtattaattatggatgtgtatgttgtagtatttgatatgaattataaatagtatgattaatataaaataatttaatttgaattatttattttttttatgtaaaatgggaaaatagaattaagaatttattttgtttattaaaataatgtttattatttttgtaatagttattaaaattggtattagttgattagtaataaatgaaaatttggtatttaaaaattaaacgtaagtaatttatggtagggtgtaatttatttattttaaatttttaattgtataaaataaagacgatataagatattaattttattttaaagttatataaaatggattatatatataattttaaatttaaaaaattgtgaatattttaaggattttaatttataaatttaatatttttttttttaatagtaagataataggagatattaatttaaatatttagatgaatattttatagtaagatgtatttatagtattaaaaagtttaagaaattattttaattaatataaaataatttagaagtatatgtgtattatttattttgaattttcgagtaataagtagtttgttttaagtttattaaaattttgtggtagattaaaattagattttattattatttattgagttgttttgaaaggtgttttatgaaagtataaataaaatagtatttaaattaaatgattatttaagagtataattttgtgaaaaacgtaaatttttataaattaagtaaaatgttttcgattatattatttttaatttattagttttatttatatttagtatattttattattcggtaattataaaggttaaagtattattaaaataaaattaaatatttaattaaatttttatttaaaaaaaaaaatttaaattgagaaatttttaagtgttataaattttattaaaaattaatattttaagaggttatacgtatataaattaaattgtaaaaaattttaggtataaaaattattatttgggttagtgtgttattttttttttttaaatgttaaaatgtttataaaaaaagtttttagaaagttaaatttattgtttatttgtgttgggtaagaaatttatgtttttatttattgtatggaatttatgttaaaagaattttgttttggttgtatattattataggatttttgtattaatttatttttttttaattttttatagtagattgttattttgattttttagtggtagggtttatttgaaattttttaagttgattgggtgtttgatgaaaaaattaaaagaaaaaaacgttgttggtattttaattttttaaatagaaaatatttatttattttgaagatattttattatatataaaatttttattttgtaatagtttttaattatgaaattgtaaagttgtatgtaaaatatatatataattttttgataagattgtacgttaaagtaataaagtttttgtattattatagatatatttgtatttataaaaaagttttagtgaagagttagatttttaatatttaatattaatattattatattgtgtatataaaaagtaaaaataaaaattaaaatttaaaatttttggaaagttaaattatagaaatattgtggattttaaattttaatgtagaaaattttttaagtttttttaaagaaaattaattatagaaaagaattttaagggatttgaaaaaaaaaaaaaatatatatatataaagtagtcgattatagtatagttttttaatttaatagatgttggttttgtttaaaaaattaaaatggttattataggtggttttttttttaacgatatatttgagaatatagaaaagatgtagtttttaaaaaaaaaaaaaaaaaaaaaagattaaaaatgtaaagtatttgtttggtttgatagatttgttataaaatgttgtttttaaattatatgtaattaaaataatatatttttattattaaaatattaaatgttttttatagaaaaataaatttattatttaaataattttaattgaagggagaagtgagaagtgagaagttagatgattttattattaaataaatgatttagatttattatgattaaatataatttgaaaaaataagatttaaattttggttttttttataaattttttagttttttatttgaatttgtggagatatagttaagtgtgattgaatttgaggtaaataaatataagggtatttttgtttattaggtaattttttgtttttttggtaataattaggatattgtttattatatataatataaaaatttatttatttaattatttggttaattgagatattgttatttatattaaaaaatattgattaaagggagtgttatagtattagtaataaatattaaaagtaagatatttttttttgattttgtttatttttttttagttttaaaaagaaaattaaattatttaatttatttttgattttagtaaaaattttttatttgatttgtttattttttaaaattaagggatatgtatttttatagagaagtataaaagtaaaaatattattttttgttagagttaattataaattaatttatttttaatttttattgttataagatttaagttttaaatgaagttggtgatgtaaatattattatgatgaataatgatattgagaatgaaaatgtattattaaattatagttatattttaatatttatagatgtaatttatttattttagtattttaatttaaaaaatttaagttttatatttttttgatataggatagagataaaatttatttagatttttttttaaaattattattttttttaaaaaatttaaagaaaatttaatgatattattaatattattttaaaattatttaaaatatattagtttatgtgataatagtagagattagaaaatagtatatttattatatttttatagttatatatttaaagatagtaaaaaaaaaaagtaaagaaaaaaatgttataagagaaaattttgataatttttaggatatgaaaaaagttatgattaatttgtatttttgtaaagttaatttaaagttaaaagtgagaattttgttaataaggaaaaagtgtttattgaggtattagagatttaggagtaatttatttatttttatagaatttaaatttttataaaaattgtatttgttaaaaaataaaaagaaattaggtttagttttgtgagtttggaaatttttttagaaataaaatttatagttttttatttgtaaaataaaaatagtatttattttttgtggttgtagaaagaatatttttataggatttttattatttgatatatagaaagattttagtaaatattagttattattttgatgtattataataattaaagtattttgagatttataaattgattttattgaattaaagtttatttatatattattagtaagagtatttttgaagaatatataggattatggggttagtagttttgtattaaaataaaattaagattttatagaaaattgggtagggtttagatattaaaattttttatatgtttttttttagtaatttgtgaattattgtagatatggaagatatgttttgatttagaattttataattagataaatttagattttttttgtattttatatataatttttaagtttataatataaatggttaataaaattttttttttttgatatttattagtttatattttttttttaaaataatgtgtatgttttaagagtattatttttatagtaaaggtaaaaatttaa

SEQ ID NO: 19 - DNA, 11260 bp, Artificial Sequence
  chemically treated genomic DNA (Homo sapiens)
tgattttattagaattatatatttaggtgaaatttttaagtgttgaagataaagttttatgttgtatttaatttggataaagtgtcgggggtattttattaagtttttgttagtaggagatagagagaaagttgttattttaaatttggaaattatgttgagtttttgtaggatgtgaaatgaagaatttagtttatggtgggataggaggagggaaaaaaattagggtgagttttattgatttaagtaattgatagatattatttatgaatggttaaatggttattagttttggtttttgattttatgtagttatggtaggaaggttattttataaattttgaagttgatattttaaggatatttgtgtgtgtgtgtgtgtatatatatatatatatatatatatatatatatatatatatatatatatatatagtttttttttttttttttttttattttttttttttgagatagggttttgttttattttttaggttggagtgtattggtaagagtatagtttattgtagttttaaaattttaggtttaagggatttttttgttttagttttttgagtagttaggattatacgtatatattattatgtttggttaatttttaagttgtttttttttttttttgtatagagatagaattttatgttttttagggtggttttgaatttttggtttttgatttttttgtttcggtattttaaagtgttattattataggtgtgagttattgtattttgggtaggatttattattttttaaatagtttaaggtatttttttaaaaatagttttttaaggtataattgatttataataaattatatatatttaaagtatatagtttgatacgttttgatttatatgtatatatttataaaattattattataattaagatgataaatttgttatttttaaaagtttttttatgtttttttgtaattttttttttttattttttttatttttgttttttagtaattagtgatttgttttttgtcgttgtggtttttattttttagaattttatataaatggaattatataatataatttttttgattgtttgtttttatttggtataattattttgagatttatttattgttgtagtgttagtagtttttaagaaaatttttttattcgtttaagaatgttattgttattttgaattaagttattagtaaaagaagagtaaatttaagatgtagtttgatttgggatttttaatttttggtattttcgtttagttgattttttttttaaatttataaggtattgtaaatattttagaatgaggatatttttttttatgtgtatttgtgtagtgattgttttatagttatttttatgaaattaaagattatttgttatttaaatttatttttgattttttgatgtattttgttattttttttttaaagaaggagttatattattttgttttttatatatattggtatggtattttaattttagtttaattttttgggtattttgttttaatttttattttattttatgtttatgagtgagtatattttagtaatttatttaagatgtttttattagtattgaagaattggaatggaagtatttataatttgttgagaagtgggaaagttatgttttagattttttataatatttgaattttaggttatttaaatttattggtttgtttttttaataaaaattatttgtttatattttttttgattaaaggagtggtggtatttaatgtaatttatttttttttttttttttttttttttttttttttgagatggagttttattttgttgtagtatagtggtacgattttagtttattgtaatttcggtttttcgggtttaagtaatttttttgttttagtttttcgagtagttgggatttataggtatgaattattatattcgattaatttttgtattgttagtagagacggggttttattatgttggttaggttggttttgaatttttgattttaggtgatttgttcgtttcggttttttaaagtgttggtattataggcgtgagttattgcgtttggttatttatttttttaaaattttggagcgtagaggttggtagtttttttaagatgtagagttattatttttatgtgaagtaaatatggatttatttattttataaattatagtttttttaattttttaaaatgtatttaattgatataattttttttaataatttaataattattttgtgtttgttgttagtaagtaagatattgtgtagatataacgatgaatagagatagttttataattttaataatagtagaaataatagaattgtagttgttattttatttagtatttatgtgtcgagtattgtgttatatattttatatatattattttaaaatgtttataataattgtgaggtaggtgatattatttttgtattatagttggtgaaattgaagtgtaaagttgtttagaattttgtataatattgtataatttacgagtgataaaattaggttttggagttagttttgatttaaaagtttatatttttttggttgtgttatgtttttttaagaagtagtaggtagtagaatggggtgggagaagtatatagattatataatagatgatattatagaatataatgtggttgttgtaagtaaagtataaataatatagtttgtggaagaaatttttaatttggattatggggaaggtattataaaggaagtgttatttgaagtgggttttgatagtgtaatattaaaggaggtaaatatttatttgggagggtatattttagggagagttaaaataatatgtaaattgagggtgatttttagaggatggtaggtagtttgatattgttaaatgggttatggtgtattggaagtagtatttagaaggttagattagatataaatgatagttaaatttgtattttttaaagtatatttaaaaggttgagtttgtaggatttattaagtggataattagatttgtatttatggtatttagtgatagttttgatttttaatttgaggttgtaagaaaaggagttttgagttggatgtttgattagttaatgtaagttttattattattttggaaattttatgaaggtaggtatttattttgatttgttagtatatttttagtatttagtaagaagtatttatgttaagtataaaatggaaatttaagagtaaggaagataaagaaatgttagaagaagagttaagagaaattaaagaagtcgatttttaaaaaattttatttagaatttttttggtgttttttatgatagttgatttttttattagtatagattgtagttatttgttagagagtaatgtgatatattaataattgtttatgtgtagttattgatttttttaataatttatagtttagtaaaattttttttttaggtttttgttatgagtatatttgtaatattgtaataaaaaggagataagtttggatttataggttttagatttagttagattaataaagagatagtatttaagttttttagaattgttatcgtttttgttttagggtgtttgaattgttaatatttataatttttttagttaggtattagaaaatggtaataagggaatggagtttttatttgttggttaagaaatgggttgttgtgtaggtaagaaatttgttttgtagaggagggggatagtatagtggagagtagaaaagattaaggagaagggtattaagggttaattttttttgaaagtttttttagagttattagattgatttttttattatttttttatttttataatattttaatttttatttttattaaattaattgaaaattgtatttttatattttttttttttttagattgaaagttttttaaatgtaaggagagttttttttatttttgtgtttgtgtatagttgatgtttaaatattttttgtattaaattgagttaggcgttgttgtaggtgttaatttaaagataagttttttgtttttatggagtttatattttatttgtaatgatagaagtatggttattatagatttttttggatttttttagtgttttttttttttttttcgtagatagtatggtaaagttgaatgtgagtgaagaaatggaatttttttagataaaaattttgtatgggataagggaagaaattttttttttttttattttttatattagatttatttttattttaggattttgaattttggttagttatatatttttttataagaattattaaatttttttgagtatgatatttttgaaattttatttatgaataaaattatgaaaaatgtaatttttttttatgtattattagtttatttggataattatatagttatttttatttattattggatgaggttttagtgattataaggtgaagttattggtggagttttaaaaatgggttattaatttgagtagttttagtatattgtatttgtttttaagttgatataattggagttgtttatatagattaattatattgtgggataaataaattttgatgaattaggttgagaagttgaatattagtaagtatattttttaaaattaaaagttttttgaagagaaatatggaattattaggttgtattatttttattagtgtttaaagtaaggatttttttatttttttaatggttgttttttaattatagttttaagggttgaattaaatgttttttttatttttaatttttttggtggagttagatatgttaatatttatgtttaggatatttgtgtaggtgtgttgatattttaagagtagtattttattataaaaattgttaatagtgattagttttggggtgatagtagtgttatagagagtaatttgagtattttattttttattgttttaagaagtgttttagaattatttttaatagtgtgaaattattttgttttttagtatttttgttatgagaaaaagaatgtgataagttatttaatttatgaaatttaagttatatgtgaattttgttaggtatgtgtgtaatatttggtatttttagttattttttatattttgggttgtaaaaatttttatagtttgtttttattaggtaagtatttgtggtgtttttttttatataaaataagttatttatttagtatgtagtttagttgatatttttattttgtttttaaataattaaattaaaagtatttaagtatatttagttatgatagatataaatatgttttaaggttttgattttttttaaaatgagttttattagttttatgggatgttttgtgaaaaagtatttaaatagtaaatagttttggtaaaaatgttatattttgggtgtttttttagttattttatattagtatattaaagattgtgaagagttttgttaaaaaaaaaaaaaaaaaataaagaaagaaagaaaagtatattttagtatttttcggatttgtttggttatatttttttttttttagtgtttattgatattttcgttgaaatgttttggggagtattgttattgaagggttaataagttattatttgaaaaagaaatagtgttatagaattattagttgagttaaatatatttgttatatagaatttttagaaagaaaataagttgatggatgggataattaattgagaatttttaaatcgaaatttaaaagtaggaaagtaattttgatttagagatgtttttttgtatttgttttgtttaaattaggatttaaaaaggtttttaatttggttgtatgtttattaaattttttttaatggaaaatagtaattttttttttttgtttttttttttatttttatgatatttatttgttgaggagattaggttatttgttttaatttatagtgatttattttagtgttttttgattttacgatggtgggaaagtaatatagttagtatattgtttaatttatggtggggttatgttttaataaatttatcgtaaattgaaaatatttgtattggatttggatgattgttttttggtggtgttgtttaatttttttttttgttttttgaatttttttgtagttggagttagggaggtttgattagatttattttcgatttttgatattttttgtttttatttttaataatttttggtgttaatttaagattaatttgtgaatttagatgttgttagtttggtttaattattatgaagtttttattaattttttttttaatggttttaaaaattagatattgatgatagttgtttagatttattattttattagggattaaagtggtggtatttttttttttttatttgttttttttttttttttttttttatgtttggttaattttttgtatttttagtagaggtggggtttcgaaagtgttagttaggatggttttttttttttttttttttttttttttaaagagatggggttttattttgttatttaggttggattgtagtggtataattataggttattgtagtttggattttttgggtttaagagatttttttgttttagtttttagagtagttgggattataggtgtatattattatgacgttattacgatattattataagtggttgttttaaattatttgtagagatggggttacgtcgttttttttaggttagttttgaatttttgggtttaagttatttttttattttagttttttaaagtgttgggattatagttatgagttattgtatttagttaaagtggtaattttttaattattttatttttttgtatttgttgaaattttataaaagattttttttttattaattttttggttattggaaatatattttatgtataaaaggtagattaaatatattgatttttttttttttttttttttttttttttttttaaattagtttttagatgagtgtatttttttagttgttgggttgtatgatttgtttgttaagtttttattggtttgttgtatgttaggttttttttttaattttttattttatttttatttagagttttgtgaaaattagtcgttttttttagatatatagttgttttttaatatttgtgggtgattggatttaggattttttgaagatattaaaatttgaggatgttttagttatttatataaaatcgtgtaatatttgtgtattatttatgtatattttttcgtatattttaaattatttttagattatttttaatatttattataatgtatatgttgtgtgaatagttgttatattatattgtttaggtaataatgataagaaaaaaagtttgtatatgtttagtatagatgtagtttttttttatatatttttgatttaagattgattgaatttatggatgtaaaatttatagatatagagggttgattgtatatatttttttatttttaattattttttatagtttgtgttttttttaaagtttttgtaaggttttttggaatatattgtttttggatgtagttatttgtataatttttgttttttttttagtattaggttaaataattgtttgttttttttttgttttttattgaggtataatttaaatagaataaaatgtattatgtagagtaaaatttgttttattaatttttttttttatggattttttgtgttttgtttaatttttgtttattttaaaattatgaagatttttttttattttttttttagaaatttatgttttgttttttatttttaggtttatgatttattgtgatttaatttttagtataatgtgagatagaatttatggggtattttttaaagttatgaatttttaattgatataatattaaggttacgaaaagttttgtgaaatgaagtttatatatttaatattttttaaatttatttggttaaaaattttttttttatgatagttattatgttttgggaaatattgatttaaagtattgataaattattgttgttaagggaatattatataattattattagttgagttaagtatttttgttatataaaatttttagaattaattattgaaaagattattttttttttatttaattgtagttgagtatttgtataaattaggtagttttatgtgtggttttatttttgtatttttttttttttatttttttgtatgtttattattggattgatattatagtgttttaattattgtaattttataatgggttatgatatttggtaataaaagttttttagtttaattataattttttatgattgttttgtttatttattgttttttgtattttgttatagattttttagtttttatatatatataaaagtattgggatttattttatttatttattttttttttttttgagatagagttttattttgttgtttaggttggagtgtagtggtatagttttagtttattgtaatttttatttttttaggtttaagtgatttttatgttttagttttttttaagtagttgggattataggtgtgtgttattatgtttagtttattttttaatttttagtagagatagggttttattatgttggttaggtttgtttcgaatttttgattttaagtgatttatttgttttagttttttagagtgttgggattgtaggtatgagttattatatttggttgaagaataaaattgatataataattttggtttgtatttatttaaagatattgaatttattatttaaaattatttagaagagaaatttttaggtttagatagttttattggtgaatttttttaatatttaaggaagaattagtatttattttatgtagatttttttagagaatggaaaagaattaatatgatttaatttttataaagttattgaatttagatatttggtaaggttattttttatgatatagattgtaaatattttaaaatacgagtaaaagggaggatttatttaagaaattttggtttgtttgtttaatatttagtgtgatatattatattaaaataataagagaaaaaaatagtatttgaatagatgtagaaaaagtatttgataaagtttaatgtttatttattattaaaattcgtaggaaattagaaattggaggaagtttttttaatttgataaagagtattcgaaaaaaatttgtagtatttgttttttttttgagatttacgtgtatttttaagattagtatttgtatagtgtaataaagttaagtataataaaatgagatatgtttgtattaggaatttttataatgtgagagcggtttgtgaagttaaaaatatttttataataatattaaaatatttatttttttaaaatttttattattttataaggatttgatgttattttttagaggatatatgatgatattataataggttgaatattagaagtatataggagaatttagttgtgttatattttgttaagttagatgttaaggatttgtaaaaagtgggaaataatgttttttttattaaattttttgttttgaaaatatattgttttaaaaaatatgtgttaatatgtagtgagtttattgttatttttaaattataaattaatatttttagaattttttagttttaatttttgatgtggttagtattgatagtatataaataaaaacgttttttgggagtttaaatttttaagagtgtagaggattttgtttgagaattgcggtgttatattgtttttatttattatttagtaagttttattagtggttagttatagttaattttgttagaatattttgtttttatttaaaaatttatatattagtattttttagtttgtaaatatttaagaagtattagaaggataatatgttatttagataaatcgtagatattatgaggaggtgttttaaatttagttataaaatagtttataatgtttatagattgtgtaggttaaaaatttgtatagggtataagaaaatggtttgtttttgttttttgtttttgtttagtattggtattagtagtaggtatttgttattaataaattgtgatttttagtgtttgttttagttttaattttttagggtattgttttttgattttatttttttgatggatgtaagaagagttgatgatttttcgtttgtttaatttatttttttttatgaggataggaatgatgatttttaagttttttatgtgttggattagaaattagaagtttagattagtgtttttttaagtgttatttttgtatttattagtgtaatattaagttgtttataggttatttgataattatagtaataaatattttggataaagtaataaaatttttgttaatatattttataaattttgtatatgagattaataatggtgattttttggaaattatttgtatttttagtgattattgcgtatatgttttaaatatgaagtagtgattattgtgaattagtatgggttttttaaaaatgagatatattaaatttttggtaaaagttttgatatattataaggaaatagtataaaatattgataagatttttaaatttggatttagaagattaatttatgatttttagtatattattaataaaaagttggaaattaaggatttagaaagagattagagttagagatatagattttgttatgttaatattattttattttttttattgggaggagagattttttgaggttgggatttattttttttttatttttgaatttttttgagttttttatagtgtttttaatataggaaaaggtgtaaatttaagaagggatttaagagtttgtttttagatatgttgatgttttggtagtatatttaggtagaaatgtttaagttaatagatataaatattttattagaatataggattggagatggagattttgttatattatttttataatagtatagtaggatttttggaagattgtatagtatttgtttatttaatttttttgaataaatgaaatgtgtttattttattataagtatttttatattgttgagtaggaaaaagtttgtttgatagagtagtgtttttaattttttttttatagtgtaaaatttgtatgttatatgtattttatttatttttataataagaaagatagaattaaaatgttagaaaagtgttttattttgtattaaaatagaaaagttaataagtttaatgaaaaattttgagatttatattttaaattattttttattttaaaatatgtattttaaagtgttttttgtttgattatagg

SEQ ID NO: 20 - DNA, 11260 bp, Artificial Sequence
  chemically treated genomic DNA (Homo sapiens)
tttataattaaatagaagatattttagagtatatattttaaaataaagaataatttaaaatataaattttaagattttttattaagtttattaatttttttattttaatataaaataaaatatttttttgatattttaattttattttttttattatgagagtagataaaatatatgtaatatgtagattttgtattataggaaaaaggttaggaatattgttttgttaggtaaatttttttttgtttaatagtgtaaaagtatttatggtgaaatgaatatattttatttatttaagaaaattaaatgagtaaatattatgtagttttttaaggattttattgtattgttatgaaaataatgtggtaaaatttttatttttagttttatattttagtggaatatttgtatttattggtttaaatatttttatttaaatatgttattaaaatattaatatgtttaaaaataaatttttaaatttttttttaaatttatatttttttttatattggaagtattatagaagatttagagaaatttaaaaataaaagagaaatggattttagttttagggaatttttttttttagtaaaggagataaggtagtattaatataataaaatttgtatttttaattttgatttttttttaaatttttaatttttaattttttgttagtggtatattgaggattataagttaattttttgagtttaagtttaaaagttttgttaatattttatgttgtttttttgtaatgtattaaaatttttgttaaagatttgatatattttatttttaggaaatttatgttggtttatagtagttattgttttatgtttaaagtatgtacgtaatgattattgagaatataaatggtttttaggaagttattattattaattttatatataaaatttgtgaaatgtgttaataaaagttttattgttttatttaaaatatttattgttataattgttaaatagtttatggataatttgatattgtattggtaggtgtaaggatgatatttggggaaatattggtttagatttttggtttttagtttaatatataaagaatttgaaagttattatttttgtttttataaagagaaataagttaaataaacggaaaattattaattttttttatatttattagagaaatgaggttaaagggtagtgttttgaaaagttaagattgaggtagatattgagaattatagtttattaatagtaaatgtttgttgttggtgttagtattaggtagagataaaaagtagagataagttatttttttgtattttgtataaatttttgatttatataatttgtgagtattataagttattttataattaaatttggaatatttttttatgatatttgcgatttatttaaataatatattatttttttagtgttttttaaatgtttataaattaaggaatattgatatataaatttttaagtaagagtaaagtattttaataagattggttgtaattgattattagtaaaatttattaaataatgagtgagaatagtatggtatcgtagtttttaaataggattttttatatttttaaaaatttaggtttttaaagaacgtttttgtttatgtattattaatattgattatattagaaattaaaattgagaaattttaaaaatattaatttatgatttaaaaataataatgaatttattgtatgttaatatatattttttaaaataatatatttttaaaataaaaaatttagtgagaaaggtattattttttattttttgtaaatttttaatatttggtttaatagagtataatatagttgaatttttttatgtgtttttggtatttaatttgttgtgatattattatgtattttttagaaaatggtattaaatttttgtgagataatgagaattttaaaaaggtaaatattttagtattattataaaaatgtttttgattttatagatcgtttttatattatgagaatttttggtataggtatattttattttattgtgtttagttttattgtattgtgtagatgttagttttaaaaatatacgtaaattttagggagaaagtagatgttgtagatttttttcggatattttttattagattaagaaagttttttttaatttttagttttttgcgagttttaatgatgagtagatattgagttttattaaatgttttttttgtatttatttagatattattttttttttttattgttttaatgtggtatattatattgaatgttgaataaataaattagaattttttaaataaatttttttttttgttcgtattttaagatgtttataatttatgttataagaaataattttgttaggtatttaagtttagtggttttataagaattgggttatgttaatttttttttattttttagaaaaatttgtataagataggtattaatttttttttaaatgttggaagaatttattagtgaagttatttgagtttggaggttttttttttgggtggttttaagtaatgaatttagtatttttaaatagatataaattaaaattattatattagttttgttttttagttaggtgtggtggtttatgtttgtaattttagtattttgggaggttgaggtaggtggattatttaaggttagaagttcgagataagtttggttaatatggtgaaattttgtttttattaaaaattaaaaaataagttgggtatggtggtatatatttgtagttttagttatttgagagaggttgaggtatgagaattatttgaatttggggaggtagaggttgtagtgagttgagattgtattattgtattttagtttgggtaatagagtgagattttgttttaaaaaaaaaaaaaataaataaataaaataaattttagtgtttttatgtatgtgtagaaattgaaaaatttgtaataaaatgtaaaagataatgaataaataaggtagttatgaagaattgtaattaagttagaggatttttattattagatattatgatttattataaaattataataattaagatattgtggtattagtttaatgataaatatataaagaaatggaaaagaaggagtatagaaatggaattatatataaggttatttgatttgtataaatgtttaattgtagttaagtgggaaaaggatggtttttttaataattggttttagaaattttatatagtaagagtatttgatttaattaataataattatgtaatatttttttgataatagtagtttattagtgttttagattaatgttttttaaagtatggtagttattatggaaaaaagatttttagttaaataaatttgggaaatgttgaatgtgtaggttttattttataggatttttcgtgattttaatgttatgttaattaaggatttataattttaaaaaatgttttatgaattttattttatattatattaaaaattaagttatagtagattatagatttaaaagtgaaaggtaaagtataagtttttagaagaaaaataggaaagaatttttatgattttggagtaggtaaaggttaaataggatataaaaggtttataaaagaaaagattgataaaatagattttattttatatagtgtattttattttgtttaaattatattttaataaaaagtaaaaaaggagtaaatagttatttaatttaatattaggaaaaagataaaaattatataggtaattatatttagagatagtgtgttttaggaaattttatagaagttttgagaaggatataaattataaaaaataattaaaaataaaagaatatgtatagttagttttttgtatttatgagttttgtatttatggatttaattaattttggattaaaaatatgtgagaaaaaattgtatttgtattaaatatgtatagatttttttttttgttattattatttaaataatatagtgtaataattatttatatagtatatgtattgtagtaggtattaaaagtaatttagagatgatttaaagtatacgggaggatgtgtataggtgatatataaatattatacgattttatataagtaattggagtatttttaaattttggtatttttaggagattttggatttaattatttatagatattgaggaataattgtatatttaaaaaaaacgattgatttttataggattttaagtagaagtggagtaagagattgaaagaaaagtttggtatatagtaaattagtaagggtttgatagataagttatataatttaataattaagaaaatgtatttatttgaaaattggtttaaaaaaaaaaaaaaaagaaagaaagaaaaaagattagtgtgtttaatttgttttttgtgtataaaatgtatttttagtaattaaagagttgatgaaggaaaagttttttatagaattttaataagtgtagaagaataaaataattagaaaattgttattttagttgggtgtagtggtttatgattataattttagtattttgggaggttgaggtgggaggatggtttgagtttaggagtttaagattagtttgggaaagacggcgtgattttatttttataaataatttaaaatagttatttgtggtagtgtcgtggtagcgttatggtggtgtatatttgtagttttagttattttggaggttgaggtaggaggattttttgagtttaggaggtttaggttgtagtaatttgtgattgtgttattgtaatttagtttgggtgataaaataagattttatttttttaaaaaaaaaaaaaaaaaaaaaaaaaggattattttggttaatattttcgaaattttatttttattaaaaatataaaaaattaattaggtatggagaagggggaggaggaggaataagtggaagaggaagaatattattattttaatttttaatgaaataatggatttgggtaattattattaatgtttgatttttaaaattattaggagaaaagttgataggaattttataatggttggattaggttgatagtatttgaatttatagattagttttaaattaatattaaaggttgttaagggtggggatagggaatgttaaaagtcgaaagtgaatttaattaagtttttttagttttaattataaggaaatttaggagatagaaaaagaagttaaataatattattaggaggtaattatttaaatttaatatagatatttttaatttacgatgggtttattgggatataattttattatgaattgagtagtatattgattgtattatttttttattatcgtaaagttaaaaaatattaagatgaattattgtaagttagaataaatgatttggtttttttaataagtaaatgttatggagatgaaaagaagagtaaaggaagagggttgttgttttttattagaagaaatttaataaatatataattaaattaaggatttttttggattttgatttgaataaaataaatgtaaaaagatatttttgagttaggattatttttttatttttaaatttcgatttaaaagtttttaattaattattttatttattaatttgttttttttttagaaattttatatagtaaatatatttgatttaattaataattttgtaatattgttttttttttaaatagtagtttgttaattttttaatagtaatgttttttaaaatattttaacggggatgttagtagatattaaagaaaaaaaggtgtggttaaataaattcgggaaatgttaaaatatatttttttttttttttttgttttttttttttttttttggtaggattttttatagtttttaatatgttaatgtaaaatgattaggggagtatttagagtatggtatttttgttaaagttatttgttatttgaatatttttttatagaatattttatgggattgatagaatttattttagaggaaattaaaattttaaaatatgtttatgtttgttatagttaagtgtatttagatgtttttaatttgattatttaaaaataaaataggagtattagttaaattatatattaagtaagtgatttgttttgtatggaaaaaaatattataaatatttatttaatagaaataagttataaagatttttataatttaaaatgtaaaaaatggttaaaaatattaaatattgtatatatatttggtagaatttatatgtaatttgaattttataagttgaataatttattatatttttttttttatggtaagaatattgaaaaataaagtggttttatattgttaaaaatagttttgaaatattttttgaaatagtagaaaataaagtgtttaaattattttttgtaatattattgttattttaaaattagttattattaataatttttataatagagtattgtttttgaaatattaatatatttatataaatattttaaatataggtattaatatatttaattttattaaagggattaaaagtggaagaaatatttaatttagtttttagggttgtgattgaagggtagttattaaaagagtaaaaaaatttttattttgaatattgatgagaatgatgtaatttagtaattttatatttttttttagaaagtttttaattttaaaaaatgtatttattgatatttagttttttagtttaatttattaaaatttatttgttttataatgtagttgatttatataaatagttttaattgtattagtttaaggataagtatagtatattgaaattatttagattgatgatttatttttaaaattttattaatggttttattttatggttattgaaattttatttagtggtaaataagagtaattatgtggttatttaaataagttaatggtgtatagaggaaaattgtattttttataattttgtttataaatgaagttttaagaatgttatgtttagaaaaatttggtaatttttgtggggaaatgtgtaattagttaaagtttagagttttggagtaaaggtggatttggtataggaaataagaagagagaaagtttttttttttgttttatgtaaaatttttatttgagagggttttatttttttatttatatttaattttattatgttgtttgcgaggagaggaaaaagaatattagaaaaatttaaggaaatttgtaatagttatgtttttgttattataagtagaatatgagttttatgagggtaaggaatttatttttgggttaatatttataatagcgtttagtttagtttagtataaggaatatttaaatattaattatatatagatataaagatgaagaaaattttttttgtatttgagaaatttttagtttagaggaaagaggaatatggaagtataatttttaattaatttggtaggaataagagttaaaatattatgagagtagagaggtagtggagggattaatttgatagttttagaaaaatttttagagggagttagtttttggtatttttttttttaattttttttattttttattatattattttttttttttataaaataagttttttatttatatagtagtttattttttagttaataaataaaaattttatttttttattattattttttaatatttagttaagagagttataaatattaatagtttaagtattttgagatagaaacgataataattttgggaggtttaaatgttatttttttgttaatttaattgaatttaaagtttataaatttaggtttattttttttttattgtagtgttgtaaatatgtttataatagaagtttggaagggaggttttgttgagttatagattgttggagaagttaatgattgtatatagataattgttaatatattatattattttttggtaagtaattataatttatattggtaggaaaattaattgttatgaaaagtattaggagagttttaggtaaaattttttagaagtcggtttttttgattttttttaattttttttttaatatttttttattttttttgtttttgagtttttattttgtatttggtatgagtattttttgttagatgttggggatgtattggtaaattaagatagatatttgtttttatggagtttttaagatagtgatggggtttatattaattaattaagtatttaatttagagtttttttttttataattttaaattaagaattaaaattattattgaatattataaatataaatttgattatttatttagtaaattttatagatttaattttttaggtatattttgagagatataaatttagttattatttatatttaatttgattttttaaatgttatttttaatatattatggtttatttaatagtattagattgtttgttattttttgaaaattatttttagtttgtatattattttagttttttttaaaatatatttttttaaatgaatgtttgttttttttgatattatattgttaaggtttattttaaataatattttttttgtgatattttttttataatttagattgaaaattttttttataagttatgttgtttatgttttgtttatagtaattatattgtgttttgtaatgttatttattatataatttgtgtgttttttttattttattttattgtttattattttttgaagaaatataatatagttaaaggaatatgagtttttgagttagaattggttttaaaatttggttttgttattcgtaagttatataatattgtgtaaggttttaagtaattttgtattttagttttattaattataatataagggtagtattatttattttatagttgttgtaagtattttaaaatagtatatgtaaagtatatagtataatgttcggtatatgagtattggataaaatggtagttgtagttttattatttttattgttattaaaattataaggttgtttttatttatcgttgtatttgtatagtattttatttgttaatagtaggtatagagtaattgttaaattgttaaaagaaattatattagttggatatattttaaaaaattaaaaaaattgtaatttgtaaaatgggtaagtttatatttattttatatggaaataataattttgtattttggagaagttattaatttttacgttttaaggttttaaagaaatagatagttaggcgtagtggtttacgtttgtaatgttagtattttgggaggtcgaggcgggtaaattatttgaggttaggagtttaagattagtttggttaatatggtgaaatttcgtttttattaataatataaaaattagtcgggtgtggtggtttatgtttgtaaattttagttattcgggaggttgaggtaggagaattgtttaaattcgggaggtcgaggttgtagtgagttgagatcgtgttattgtgttgtaatagagtgagattttattttaaaaaaaaaaaaaaaagaaaagaaagaaagaaatagattatattaaatattattatttttttaattaggaaaagtgtaaatagatgatttttattaaagagatagattagtaaatttgggtaatttaaagtttaaatattatgaaaaatttaaaatatgatttttttattttttagtaaattgtaaatatttttattttaattttttaatattggtgaaggtattttaagtaaattgttgaaatatatttatttatgaatataaagtaaaatgaaggttaaagtaaaatgtttaaaaagttaagttaaaattaaagtgttatattaatgtgtgtaaaaagtagaataatataattttttttttgagaaaaaaataataaaatatattaggaaattaggaataaatttaagtaataaataatttttaattttatagaggtaattatgaagtagttattgtatagatatatataagaaaaagtgtttttattttggaatgtttataatgttttgtgggtttaaaaaaaaaattagttaggcgaaaatgttaaagattaaaagttttaaattagattgtattttggatttgttttttttttattaataatttggtttaaagtgataatggtatttttaagcgaataaagagatttttttgaaaattattgatattataataatggatgaattttaaaataattatgttaagtgaaagtagatagttaaagaaattatattgtatgattttatttatataaaattttagaaaatgaaaattatagcgatagaaagtagattattggttgttgagggataggagtagaaggagtgggagggaaggattataaaggggtatgagaaaatttttgagggtgataaatttattattttgattgtggtgatggttttatgggtgtatatatataagttaaaacgtattaagttgtatattttgaatatgtataatttattataagttaattatattttaaaaagttgtttttaaaaggatattttgaattgtttgaaaaataataaattttgtttaaggtgtaatggtttatatttgtaatgatagtattttggggtgtcgaggtagaaggattagaggttaggagtttaagattattttggggaatataaggttttgtttttatataaaaaaaaaaaaaagtaatttaaaaattagttaggtatggtggtatgtgcgtgtagttttagttgtttaggaggttgaggtaggagaattttttgagtttaggattttgagattgtagtgaattatgtttttgttaatatattttagtttgggggatagagtaagattttattttaggaaaaaaaaataaaaaaaaaaaaaaaaaaaaattatatatatatatatatatatgtatatatatatgtgtgtgtatatatatgtatatatatatatatatataaatatttttaaaatattaattttaaggtttgtgaaataatttttttgttatagttgtatgaagttaaagattagggttaatgattatttgattatttataaatggtatttgttaattatttaagttagtgaaatttattttagtttttttttttttttttattttattatgggttggattttttattttatattttataaaaatttagtataatttttaggtttgaaatggtaattttttttttgttttttattggtaggggtttaataaagtgttttcggtattttatttaaattaaatataatatgaagttttatttttaatatttaaaaattttatttaggtatgtggttttggtagaatta

SEQ ID NO: 21 - DNA, 5687 bp, Artificial Sequence
  chemically treated genomic DNA (Homo sapiens)
gggatatggatgaaattggaaattattatttttagtaaattatcgtaagaataaaaaattaaacgtcgtatatttttatttataggtgggaattgaataatgagaatataaggatataggaaggggaatattatattttggggattgttgtggggtgggaggaggggggagggatagtattaggagatatatttaacgttaaatgacgagtaaatgggtgtagtatattagtatggtatatgtatagatatgtaattaatttgtatattgtgtatatgtattttaatatttaaagtataattaaaaaaaaaaaaaagtaatagtaagttttttacgagaggggcgggtgtagttttttatgtggacggtagagagaggagaggggttttttatttttgagcgtttgttttttattgttttaaatagtagttatatggtgttttggtgtgttagggattttgtgtattttttattttatttttatcgtattttaattgttttagtaggtgaggaggtatttgtttttttttttttttttttgtttttttgagatggagttttgtttttgttatcgaggttagagtgtaatggtgtaattttggtttattataattttcgttttttgggtttaggtaattattttgttttagtttttcgagtagttgggattataggtatgtatttttaaggtcggttaattttgtatttttagtagagatggagtttttttatgttggttaggtaggtttcgaatttttaattttaggtgatttgttcgttttggttttttaaagtgttgggattataggtgtgagttattatatttggtcgaggtatttgtttttaaaatagttaagaaaaagtagtaggtttgggatttgaatttagttttgtttggatttttttatattattagattatattttgttttttgtttattaggaattggttggaattttgtttttttgggattatttttttaggtttttgttttttaatttcgggatttttatttttgggggattagttattatgattttgtgttattttgatttggattttttgtttatttttttaatgtgtgttttgtttgtgtttttttttttaatgttgttttgtatcgtttgaaggtaaagtttaaatttgatgttattttttaatttatttaagtttagaaagggataattaatattaaattgtaataattttatttttttttttttttttttttttttttgtgagacgaagttttatttttgttgtttaggttggagtgcgattttggtttattgtaattttcgtttttcgggtttaagtaattttgttttagttttttaagtagttgggattataggtgtttttttattatgtttagttatttatttgtatttttagtagagatagggttttattttattggttaggttggtttcgaatttttgattttaagtgatttatttattttagttttttaaagtgttaggattataggcgtgagtcgtcgtatttagttaataattttaattttattttttttttttttttttttttttttttttttttttttagatagtattttattgttgtttagattggagtgtagtggtttgattatagtttattgtagttttaattttttgagttttagtgattttattgttttggttttttaggtagttgggattataggtgtatgttattacgtttagtttattttttaatattttgttgtagagatgagggttttattgttgtttaggttggttttaaatttttgggttttagagatttttttatttcggttttttaaagtgtcgggattataggtatgagttattatgtttagttttttgattgttttttaatgtggtatttgagattggagagggtgaggtttgtggaaagagtaggaagttttaggtgtgtatcggagtgaagttttttcgtggttgggtggtttgtttttttttgtgttttatttttttatttgtgaaatgaggataatttttttttttaggattgtaggaagtgttatttatgggaggtatggtagagcggtttggtatttttaaggtatttatttgttgaaggtgatttttagttaagtgagtgtaggtaggagttacgtttttttttttgttatttttttattagtgtttgagtttagggttttttgagttagattgaagggagaagaaatcgaaaggaaagaaaaaataggtattagtgaatattagaattgattaaaatgatataggtgagaataatgagatagaaaaagggattgtagagtcggtatattttgagggtggaatatggtgagataggaagattagggtttttggagagtgaggatatgggttttaggtttagatttgttatgttcgggttatttatttttgagtttttgcgattgagtttttttgtttttttttgtaaaatggaaatttgttagggaatggtttaagtttttgtgtttatttttgtgtaaattatttattaatggatttttggggggttgtatggtgtttttattgttttaaggtaggttttaagatttttaggtggttggatattttgtttcgtttgaagagtggtttggagttattttaggttggggtttattttttttagtggtttgaaggtttttaggatttagagtatttgatatagtttattatttatttagttttataaatttatttttttttgtagagtattgtttttgtgattaagatattatttttgtttcgaaggagtttatagatttttggtgagacggatatttagagtatttagatatagggtgtggtttgttttgtgttattgatatattttttgttatttttgtgtaaattgattttttgaatatttttatttatggtttttagggtgtgttattttaattttttgaatatatggggatttttttatgtttggttaaggggattagtatagttttaatgtttttgggatttttaagagttatttgatgtataagtaaaaatatgaattaattcgggggtagtggaggcggggaagatggggtaggatgtgttatgtgtttttttatagagtttagaagtgatatgggagtcgaggagtgggttaggagggttttttggagtaggtgatatttgaattgggttttggaggatgagttagaatttgttaggtatgtttttttagtatagggattagtatttgaaaaaaaaaaaaaaaaagtttgaatgatgtgaattgtttattggttaagtgggtgtaggatgatgatggtgaagtgagttatgtaaagtagaagagatagatttaagagcggtattacggtttaagattttgagtagtataggtaaatagagaaaagtagaacgattatttaattttgatatttaaggatagttattatatgtatatatatttatgtttttaagagaatttatacgtgtttttttttaaagaaagattatgtagtgttttttttttttatgtttgggattttgttttgttttgttttgtttttgagacggagttttatttttgtcgtttaggatggagtgtaatggcgagatttcggtttattggtttttttagtttaagtgattttcgtattttagtttttcgagtagttgggattataggcgtacgtcgttacgtttagttaatgtttgtatttttggtagagatggggttttattatgttggttaggttggttttgaatttttgattttaggtgatttgttatcgcgtttggttagggagttgttttaaatagatttttttttttttttttcgggatgttaattttggtgttgcgtggggagtaacgtggagagtaaagaatatttaagtgagtagttgttattatagttatcgggatagtgcgggaggagtagttttttaggtaaagatcgtgggtagaggggcgcgtggcgggtgagagggaggagttcgcgttgatttacgggtttttggtttaggaaatagtggagttgttgatatttttatgaggaagtcgggtaagtttggaggggtagataattaattgggatgggaatatttcgggtattcgtagaagtgtttcgcgggttgtggtttcgcgtgggggattttttaggttcgtatttttgtttggggtatttgcgaggcgttaggtaagttgtttggggcggggagtgcggtttgagcgtttaggtttaagtttcgatgcgcgggttttttttcgtttaggtcggttttcgttatttcgtttttataggtgagggtgtttgttttgtcgttttgggatgcgaataggcgtgaggtttttttattttttagtgttacgaggtagggcgggattcgaatttcggttttgttattttttgtttcgattattttggagtagttgttcgtttttcgttttagtttttttattcgtttatttcgtcggtaggatttaagggcggtttgtaatttgtagaggttattttatttttttggtcggcggcgaaggttagtggcgcggtttgggttggggtcgtttcgatcgttttcgatcgacgttatttaggagggtttggggaaggggacgcgaggagttgggaatacgtagcgtcgttttagcgggacgggcgggttcgggttggcgtcgaattcgcgttcgagagtttagttcgcggttaggtcgtcgttttcggagttcgttggggttcggagtttcggttttttacgtttggtcgttattagaataaaagttgtggtttagttcggagtttaggcgtttcgtaggtttggttcgcgtcgggtcgttagtttttttacgtttggcggtcgcgtttttagtttttcggttcgagtacgttcggtttttttcgttacggtcggcgtaggtggagggggcggggcgggggtcgtgcgtggtgacgtcgcgggggggtgacgtatcggcgtgtttcgtttttatttttttttcgtttaggttttggaaagagaagaaaaaaaatttttttttttttttaattgaggaattaatagtcgttattttgtcgcggattcgatcggggtttcgagcgcgatttattcggtttcgtcggtttcgggttttataatcgttcgcgtatttcgtttcgttcggtcggttcgtttcgttcggttttcggcgttcgtttcggcggtttcgttcgtttttcggttcggtttttcggagttcggcggcggcggcggcggtagcggcggcggcggcggcggaacggggggtgggggggtcgcggcggcggcggcgatttcgttcggcgtattgtttttttttacggcggcggcggcggcgggtcgcgggtcgggagcggagttcggagttttttcgtcgtcgggtcgcgagcgaatttattaagtggggcgcggggggggagcgaggcggcggcggcggcggtattatgttttcggggattgtttgagtcgttcggtcgggcgtcgtcgttgttagtcgggttcgggggggcggtcgggtcgtcggggcgtttttatcgcggagtgtcgcgttcgggaggcgggtaggggatgagggggtcgcggtcggcggcggcggcggcggtcgggggcgggcggtgagcgttgcggggcgttgttgttgtggttgagatttggtcgtcgttttttttattcggtttgcgttttttttttttttcggcgttcgttcgttcgttcgcgg

SEQ ID NO: 22 - DNA, 5687 bp, Artificial Sequence
  chemically treated genomic DNA (Homo sapiens)
tcgcgagcgggcgggcgggcgtcgagggagagggagggcgtaggtcgggtgggggaggcggcggttaaattttagttatagtaatagcgtttcgtagcgtttatcgttcgttttcggtcgtcgtcgtcgtcgtcggtcgcggtttttttattttttgttcgtttttcgagcgcgatatttcgcggtgggggcgtttcggcggttcggtcgttttttcgggttcggttggtagcgacggcgttcggtcgggcggtttaggtagttttcgagaatatggtgtcgtcgtcgtcgtcgtttcgtttttttttcgcgttttatttaatgaattcgttcgcggttcgacgacgagggggtttcgggtttcgttttcggttcgcggttcgtcgtcgtcgtcgtcgtgaggaaaaataatgcgtcgagcggggtcgtcgtcgtcgtcgcggtttttttatttttcgtttcgtcgtcgtcgtcgtcgttgtcgtcgtcgtcgtcgtcgggtttcgggaggtcgagtcgagaggcgagcggggtcgtcggggcgggcgtcgagggtcgggcggagcgggtcggtcgggcggagcggggtgcgcgggcggttgtggggttcgggatcggcggggtcgagtagatcgcgttcgaagtttcggtcgggttcgcgataagatggcggttgttgattttttaattaaaaaaaaaagaaagtttttttttttttttttttagagtttgaacggggagggggtgggggcggggtacgtcggtgcgttattttttcgcggcgttattacgtacggttttcgtttcgttttttttatttgcgtcggtcgtggcggaaagagtcgagcgtgttcgggtcgaagggttgaaggcgcggtcgttaagcgtagggaagttggcggttcggcgcgggttaggtttgcggggcgtttgggtttcgggttgagttatagtttttgttttgatggcgattaggcgtagagggtcggggtttcgggttttagcgggtttcgggagcggcggtttggtcgcgggttgggttttcgggcgcggattcgacgttagttcgggttcgttcgtttcgttggggcggcgttgcgtgtttttagtttttcgcgtttttttttttagatttttttaggtggcgtcggtcgggaacggtcggggcgattttagtttaggtcgcgttattagttttcgtcgtcggttagggaagtggaatggtttttgtaggttatagatcgtttttgggttttgtcgacgaggtgggcggatggggaaattgaggcggggggcgagtaattgttttaaagtggtcgaggtaggaagtggtagggtcgggattcgggtttcgttttatttcgtgatattagggagtgagggggttttacgtttgttcgtattttaaggcggtagggtagatatttttatttgtgagagcggggtggcgagggtcggtttgggcggagaagggttcgcgtatcggggtttaagtttggacgtttaggtcgtatttttcgttttaggtaatttgtttggcgtttcgtaggtgttttagataggggtgcgggtttggggagttttttacgcgagattatagttcgcgggatatttttacgaatattcgaggtgtttttattttagttagttatttgtttttttaaatttgttcggtttttttataaaggtattagtagttttattgttttttaagttagaaattcgtgagttagcgcggattttttttttttattcgttacgcgtttttttatttacggtttttatttgggagattgtttttttcgtattgtttcggtggttatggtggtagttatttatttaagtgttttttgttttttacgttgttttttacgtagtattagagttaatatttcgaaaagagagggagaaaatttgtttaaaataattttttggttaggcgcggtggtagattatttgaggttaggagtttaagattagtttggttaatatggtgaaattttatttttattaaaaatataaatattagttgggcgtggcggcgtgcgtttgtaattttagttattcgggaggttgagatgcgagaattatttgaattggggaggttagtaagtcgggatttcgttattgtattttattttgggcgataagagtgaaatttcgttttaaaaataaaataaaataaaataaaattttagatatagaaaaagaaaatattatatagtttttttttaaaaaagaatacgtatgaatttttttaaaaatataggtgtatgtatatatggtgattgtttttgagtgttaagattgagtgatcgttttgtttttttttgtttatttgtattgtttaaaattttgggtcgtgatatcgtttttgaatttgttttttttattttatatggtttattttattattattattttatatttatttggttagtaggtagtttatattatttaggtttttttttttttttttttaaatgttggtttttgtgttgagaagatatgtttggtaaattttaatttattttttagaatttagtttaaatgttatttattttaggaagtttttttagtttatttttcggtttttatattatttttgggttttgtgagagaatatataatatattttgttttatttttttcgtttttattgttttcgaattagtttatgtttttatttatgtattaaatagtttttgagaattttaagggtattgagattgtgttaatttttttggttaaatataaagagatttttatatatttaaggagttaaaatagtatattttggaagttataaatggaagtatttaagaagttagtttgtataggaatggtaagaagtgtattagtggtatagggtaggttatattttgtatttgaatgttttgggtgttcgttttattaagggtttgtgagttttttcggggtaaagatggtgttttagttatagaaatagtgttttgtaagaagaagtaggtttgtaaaattgaatgagtgatgagttgtgttaggtgttttgagttttagaggtttttaggttattgaaaagggtgggttttagtttgaggtggttttaggttattttttaaacgggataaggtgtttagttatttagaggttttagggtttgttttggggtagtggagatattatgtagttttttaggggtttattggtgagtggtttatatagaagtgggtataggagtttgagttattttttgataggtttttattttatagaggaaagtaagggaatttagtcgtaaggatttagaagtaaataattcggatatggtaagtttgggtttggaatttatgtttttattttttaaagattttagtttttttgttttattatgttttatttttaaaatatatcggttttgtagtttttttttttgttttattgtttttatttgtattattttgattaattttggtatttattgatatttgtttttttttttttttcgattttttttttttttagtttgatttaaagaattttgagtttagatattgatgggggaatagtaaggagggaagcgtggtttttgtttgtatttatttagttggggattatttttaataagtgagtgttttagggatattaggtcgttttgttatgttttttatggatagtattttttataattttggaaggaaaaattgtttttattttatagatgaagaaataaggtataaaggaggataagttatttagttacgaaggggttttatttcggtgtatatttaaggttttttgttttttttataaattttattttttttagttttagatattatattaaaaaataattaaaggattgggtatgatggtttatgtttgtaatttcggtattttaggaggtcgaggtggaaggatttttagagtttaggagtttgagattagtttgggtaatagtgagatttttatttttataataaaatgttaaaaagtgaattgggcgtggtggtatgtatttgtagttttagttgtttgggagattaaggtaataggattattggagtttaggaggttgaggttgtagtgagttatgattaaattattgtattttagtttgggtaatagtgagatattgtttaaaaaaaaagaaaagaaaagaaaagaaagagaaagaaatggaattggaattgttggttggatgcggcggtttacgtttgtaattttagtattttgggaggttaaggtgagtggattatttgaggttaggagttcgagattagtttggttaataaggtgaaattttatttttattaaaagtataaataaatggttgggtatggtgggggggtatttgtaattttagttatttgggaggttgaggtagaattgtttgaattcgggaggcggaggttgtagtgagttaagatcgtattttagtttgggtaataagaatgaaatttcgttttataaaaaaaaaaaaaaaaaaaaaaagaaatggaattgttgtaatttgatattgattgtttttttttaggtttaaatagattaaaagatagtattaggtttggattttgtttttaagcgatgtagaatagtattggggagaaaaatataaataggatatatattgaaaagataagtagagaatttaagttagaatagtataaaattataataattgattttttaggggtgggagtttcggggttggggggtagaggtttgggggagtagttttaggaaggtaggattttagttagtttttggtggatagaaggtagaatgtggtttggtggtgtggagggatttagatagagttaggtttaagttttaaatttattgtttttttttagttgttttgaaaataaatatttcggttaggtgtggtggtttatatttgtaattttagtattttaggaggttaaggcgggtagattatttgaggttgggagttcgagatttgtttgattaatatggagaaattttatttttattaaaaatataaaattagtcggttttggaggtgtatgtttgtaattttagttattcgggaggttgaggtaggataattgtttgaatttaggaggcggaggttgtggtgagttaagattgtattattgtattttagtttcggtaataggagtaaaattttattttaaaaaaataaaaaaagaaaaaaaaaaataaatatttttttatttgttgagatagttgaggtgcggtggagatgagatggagggtgtatagggtttttggtatattaaggtattatatagttgttatttggggtagtgggaagtaggcgtttaagggtgagaggttttttttttttttttgtcgtttatatgggaggttgtattcgtttttttcgtgggggatttgttgttgtttttttttttttttaattatattttaagtgttagggtatatgtgtataatgtgtaggttagttatatatttatatatgtgttatgttggtgtgttgtatttatttattcgttatttagcgttaggtatattttttaatgttattttttttttttttttttattttataatagtttttagagtgtgatgtttttttttttgtgtttttgtgtttttattgtttaatttttatttatgagtgagaatatgcggcgtttggttttttgtttttgcgatagtttattgagaatgatgatttttaattttatttatgtttt

SEQ ID NO: 23 - DNA, 6158 bp, Artificial Sequence
  chemically treated genomic DNA (Homo sapiens)
ataaggaagtaatgtttttattaagtttgtttaattgttagatggaaattgtatttgtttgttatttgggggatttatggaaatattgtaattgataaaatttatagttataaaaatattgtaatatatgtgttaatagtgttgtatttgttttatgaatgatgttggttgatatatatatatatatatatatatatatatatatatataattgtgggtaaaaaagtagttgtaaaattaatagatttgtgttttggatgtcgagtgaagaaaatgtttttaggtcggatatagtggtttatagttataattttagtattttggaaggttgaggtaataggattatttgaggttaggagtttaagattagtttgggtaataaagcgagatttttatttttataaaaaaatttaaaaattagttgggtatagtagtgtatgtttgtagttttagttatttgggaggttgaggtagggggattgtttgagtttgaggttatagggagttatgatttgtgttattgtattttagtttgagtgaaagtaagattttgttttatttatttatttttatttttattgttaagattttgttgtgtgtgtgtgtgtttttaaaaaaaggttttaaaagaagggagtgattaattttattaaatattgttggtagaattttataagataaagaggattaaaattgattagtgtatttggtaattgggaagttataggtgattaggaaaagagttgtttttggatgttttatagttgttattgttattgtgaggaaatttttttatttatgattttttttttttttttttttttttgagatggagttttatttagttttttaggttggagtgtagtggcgagattttagtttattgtaagttttatttttcgggtttacgttatttttttgttttagtttttttaatagttgggattataggcgttttttttattacgtttagttaatttttttttttgtattttttagtagagatggggttttatcgtgttagttaggatggtttcgattttttgattttgtgatttatttattttagttttttaaagtgttgggattataggcgtgagttatcgtggttggtttatttatgatttttttttaattattaatttatattttttgaaatagggtttttttttgttgtttaggttggagtgtagtggtgtgattatagtttattgtaatttttaatttttgggtttaagtaatttttttattttttaagtagttgggattataggtatgcgatattaaaattagttaatttttaaaattttttgtagaggggttatgcgatgttgtttaggttggttttaaatttttgtgtttaagtgattttttttttttggttttttaaagtgttgggattataagcgtgagttattatatttagtttttttatattttatgtgaatatggaagagaatgttattatttatagaaaatataaattgattattttgggattgttataatgtttgtaatttatttttatattattttgtgaataaaattttaaattgtaatattaaaagattttaggtagaaaaataaaaataaaaaataatttggttttttttgttaaaaaaaaaattatgtacgtaaatatatatatataaagtaaatatattaaaatgttaattaaggtggtagttatataggtatttattgtattattatttaaatttttatttttatatttgttaaaaatattggaaaaaatgagggttaggcgttatagtttatatttgtaattttaatattttgggaggttaaggtagacggattgtttgagtttaggagtttaagattagtttgggtaatatggtgaaattttgtttttattaaaaatataaaaattagttaggtatggtggtaggcgtttataattttaattatttagaaggttgaggtaggagaatcgtttgaatttgagaggtagaggttgtagtgagttaagatcgtgttattgtattttagtttgggcgatagagggggattttgttaaaataaaataataaattggaaaaaatggtatttgagataaattttgaaagagtatgaatattgttttaagattttgttgtttttatattagtttaataaagaaaaattagaaggtagataaaaagagtaaatttatggggtttttaatgtagatataatcgtttttaatttttttaagttatatataggttgaggttggatgtggtggtttacgtttgtaattttagtattttgggaggttaaggttagtggattatttgaggttaggagtttaagattagtttgattaatatggtgaaattttgtttcgattaaaaatataaaaattagttcggtgtggtggtgggagtttgtaattttagttattaaggaggttgaggtacgagaattatttgaatttaggaggtagagtttgtagtgagtcgagatcgtattattgtattttagtttgggtgaaagggcgagatttagtgttaaaaaaaaaaaaaaaaaaaaaaaaaaaaaaaaaatatatatatatatatatatatatatatatatttataataggttgagtatttttaatttaaaaatttgggttaggcgcgttagtttacgtttgttattttaatttttggggaggtcgagttgggtggattatttgaggttaggagtttagattagtttggttaatatggtgaaattttttttttattaaaaatataaaaaaattagttagggcggtggtaggcgtttgtagttttaggtatttgggaggttgaggtaggagagtggagtgaatttaggaggcggagtttgggagtttgtagtgagtcgagattgtgttattgtattttagtttgggcgatagagcgagatttcgttttaaaaaaaaaaaaagaaaaagaaaaaatataaaaattagtcgggcgtggtggcgtacgtttgtaattttagttatttaggaggttgaggtaggagaatcgtttgaatttgggaggtgtagggtgtagtgagtcgagatcgtattattgtatttcggtttgggcgatagagtaagattttgttttaagaaaaaaaaaaaaaaaaatttaaatgttttaaaatttaaaacgttttaaaatttaattttttaagtattgatatgatttttaaaggaaatgtttattggagtattttagattttggatttttagattaggatgttaaagtggtaagtatatatacgtaaaatatttttatattttgtttttttttatttaatacggtggttgtttttttgttagttatcgtatattagtattagtttgttgtgtgatattttattgtagagataaattttgtgatatttttaattagttttttattgttggatggtgtaatgaatatttgttaatatatattttttgtttatgtgtttgattattttaagggtaagattttagtttgtggaaagggagtaagtgtaagtttgagtagaggaaaggagatttaaaagaataaggcgagtttgggaatagtttattaggttattttagggtattggattttcgtaggcgagaaatgtttgtagatatttaacgatgacgtttaaatggaagagtagtttgagaagatttagtattatttaattttttattttttattttttttgagacggagtttcgttttgtagtttaggttggaatttcggtttattgtaattttcgtttcgcgggtttaagcgatttttttgtttaagtttttcgagtaattgggattataggcgtaaattattacgttcggttattttttttgtatttttggtagagacgagattttattaagttggttaggttggttttgaatttttgattttatttatttattttttgagacggagtttcgttttgtcgtttaggttggagtgtagtggcgcgatttcggtttattgtaagtttcgttttttaggtttacgttagttttttgttttagtattcggagtagttgggattataggcgttcgttattacgttcggttaatttttttttttgtgtgtgtgtatttttagtagagacggggttttatcgtattagttaggatggttttattttttgattttgtgattcgttcgttttagttttttaaagtgttgcgattataggcgtgagttatcgtatttggtttagaatttttgattttaaatgatttattcgttttggttttttaaattgttgggattataggcgtgggttatcgcgtttagttaattttatttaattttaatgttaggtattgttttaatatttttttatgtataatttattttatttgtaggtattattattatttttatttataggttagaaagttgaggtacgaagtttaattattagagttatttattttcgttaaaatttaagtagtttgggttataaataattatatttattttgtagttaaggaattaagttgagatgttgagttgaaaatttaggttttagattttaaagttttttatataagagtcgacggtggtagtaaaaattaatgggggtttgatttattttttttatttttaagaaaagtaaaaagtaggagttgggattagagaaaatttttacggagtttttattttttaaatataagaggtatttaacgtttagtattgttgatttgtaattaggttttaattgtgagtagttaggttttaaagtttgataattgaattttaaaaagcgcgcgagtttttaggcgaaatagtttttcgttttttagtcggttggagtcggtttagtaatagtttttttaagttagggtagtgacgttagtttaggaattgggttcgtttcgggatttcgttgttttttgtacgttcggaataattagagtcgcgaaattagtttcgtttattgtttcggaagttaatgcggaagttatatatttttttttcggtcggtaggggcgtagttattttaatttatatttgagtgggcggtggcgattggtgttggcggtttggtttagttgggtagggggtaattttattgatttgggggtggtttttagtttaattttttttttttagttttttatcgacggttagtgcgtacgttgtaattagttgaggttatgttaggagacggagttacggagtaggtgaggaaggagagtggtggggtttcgtggcgattttttttttacgtttgttttttcgattgttttagatatgttcggttgaggaaggaattgggtttagtgaattcgggggatagggtatatagaagagtggtgggaatggggagtaagatttaagatttaatttttttttttttattttttttttttaggtatgaatacgagtaaatatttgatttagataatagcggtaggttgtttcgttttatttagatttatgggattattttagatgggatgtttttttttgatatcgttttggtattagagtggataggaattattttaacgtgtattcgacgttttagaaaaatttgatagtgttttttttatttcgttaaatatattgtatttagaaataggttattagtttgagaaatatttgagataaagttaatttggagaattaagatttaatgagagcgagtgaagaaagaagtaagttatgttgaggttttgggaattttgtggttttttttcgttttttttttttttagttatatttcgtttttatttttttagttatataaatattgtaggtataagttgaaaatgagaagtttgttttggttattgtaaataaaagtatttgttttaatagtaaatatgagtgataattaaatattttaaaatttatatttttaggttagattagtgtgatttgttttttttgttttttgtatttagaattttgtaggatagtatttattttttagtgtgaaagaggaagttaaatagttatgaaaaatgttattaaatgtgtttttcgatttaagttttggtgtgtttagataaatatagtttttaaaatggaggttaggtagtttgtagttttaattttttgaaattttttattgttatagtaacgatatgtatttaggttttcgttttttaggttttttagtttataacgtggaagatgttattggaggttggtagagatgaggtaaaataggagcgt

SEQ ID NO: 24 - DNA, 6158 bp, Artificial Sequence
  chemically treated genomic DNA (Homo sapiens)
acgtttttattttgttttatttttgttaatttttaataatattttttacgttataagttagggaatttgaaaaacgaaaatttaagtgtatgtcgttgttatggtaatgggaaattttaggaaattgagattgtaggttatttagtttttattttagaaattgtatttatttaaatatattaggatttagatcgaaaaatatatttaatggtattttttataattatttagtttttttttttatattaaaaggtaaatattattttataaaattttgaatataaagagtaaaagaaataaattatattgatttaatttaaaagtgtgaattttaaaatatttagttgttatttatatttattattaaaatagatgtttttatttatagtggttaaaatagattttttatttttaatttatatttgtaatgtttatgtagttggaaaaatgaaaacgaaatgtggttaaaagaaaagaaaacgaaagaaagttataaaatttttaaaattttagtataatttgtttttttttttattcgtttttattaagttttaattttttagattagttttgttttaaatattttttaaattagtaatttatttttgggtatagtatatttggcggggtaaaagaaatattgttaagtttttttaaaacgtcgggtgtacgttaaaataatttttatttattttaatattaaaacgatattaaaggaaagtattttatttggagtagttttatgaatttaaataggacgaagtagtttatcgttattgtttaaattaagtatttattcgtatttatgtttaagagagagaagtaaaaaaaaaaaaattaaattttagattttgttttttatttttattatttttttatatattttgtttttcgggtttattagatttaattttttttttagtcgaatatgtttggagtagtcggaggaatagacgtggagaagaggtcgttacgaggttttattattttttttttttatttgtttcgtggtttcgttttttgatatggttttagttgattataacgtgcgtattgatcgtcgatgggaagttagaaaagaaaaattaaattaaaaattatttttaaattagtaaagttattttttgtttagttgagttagatcgttaatattaatcgttatcgtttatttaaatatgaattaaaatggttgcgtttttgtcggtcgaggaggaggtgtgtggttttcgtattaattttcggggtagtgggcggggttaatttcgcgattttggttatttcgagcgtgtagaaagtagcgagatttcggggcgggtttaatttttgggttgacgttattattttggtttggagaggttgttgttgagtcggttttaatcggttggaaggcgggaagttgtttcgtttggaggttcgcgcgttttttggaatttagttattaagttttagagtttggttatttatagttgaagtttgattgtaggttagtaatgttaaacgttaaatgttttttatatttaggggataaggatttcgtggaggttttttttggttttagtttttgttttttattttttttgggggtgggagggatagattaagtttttattaatttttattgttatcgtcgatttttgtgtagaaagttttgaagtttgagatttgggtttttagtttaatattttagtttggttttttgattgtaaagtaggtataattgtttgtagtttagattgtttggattttaacgaagataagtaattttggtaattaaatttcgtattttagttttttggtttatagatgggaataataatagtatttgtaagtgaaataaattatatatagaaaagtgttagaatagtatttggtattaagattaaatgagattgattgggcgcggtggtttacgtttgtaattttagtagtttgggaggttaaaacggatggattatttaaagttaggagttttaggttaggtgcggtggtttacgtttgtaatcgtagtattttgggaggttgaggcgggcggattataaggttaggagatgagattattttggttaatacggtaaaatttcgtttttattaaaaatatatatatataaaaaaaaaaattagtcgggcgtggtggcgggcgtttgtagttttagttatttcggatgttgaggtaggagattggcgtgaatttgggaggcggagtttgtagtgagtcgagatcgcgttattgtattttagtttgggcggtagagcgagatttcgttttagaaaataaataaataaagttaggaatttaggattaatttggttaatttggtgaaatttcgtttttattaaaaatataaaaaaagtagtcgggcgtggtggtttgcgtttgtagttttagttattcgggaagtttaagtaggagaatcgtttgaattcgcgaggcggaggttgtagtgagtcgagattttagtttggattatagagcgagatttcgttttaaaaaaaataaaaaataaaaaattaaatgatattaaatttttttaaattgtttttttatttaagcgttatcgttagatgtttgtaagtatttttcgtttacgggggtttaatgttttaaaataatttagtgaattgtttttagattcgttttatttttttaggtttttttttttttgtttaaatttatatttattttttttttataggttgaaattttatttttaaaataattagatatatgagtaaaagatatgtattaatagatgtttattgtattatttagtaatggaggattggttaaaaatattataagatttatttttgtaatggaatattatatagtaaattgatgttaatgtacgatgattgatagaaaggtaattatcgtattaaatgaagaaaagtagaatatgaaagtgttttacgtatatatatttattattttagtattttaatttgaaaatttaaaatttgaaatattttaatgagtattttttttgagagttatgttagtgtttaaaaagttagattttggagcgttttgagttttggaatatttaggttttttttttttttttttttgaggtagagttttgttttgtcgtttaggtcggagtgtagtggtgcgatttcggtttattgtattttatattttttaggtttaagcgatttttttgttttagttttttgagtagttgggattataggcgtgcgttattacgttcggttaatttttgtattttttttttttttttttttttttttgagacggagtttcgttttgtcgtttaggttggagtgtagtggtataatttcggtttattgtaagtttttaagtttcgttttttgggtttattttatttttttgttttagttttttaagtatttgggattataggcgtttgttatcgttttggttaatttttttgtatttttagtaaagaaggggttttattatgttggttaagttggtttgaatttttggttttaagtgatttatttaattcggtttttttaaggattgggatgataggcgtgagttaacgcgtttggtttagatttttgaattagggatatttaatttgttataaatatatatatatatatatatatatatatatattttttttttttttttttttttttttttttttttgatattgagtttcgtttttttatttaggttggagtgtagtggtgcgatttcggtttattgtaagttttgttttttgggtttaagtgattttcgtgttttagtttttttagtagttgggattataggtttttattattatatcgggttaatttttgtatttttagtcgagataggattttattatattggttaggttggttttgaatttttgattttaggtgatttattggttttggttttttaaagtgttgggattataggcgtgagttattatatttagttttaatttgtatatagtttaaaaaaattaaaagcggttatatttatattgggggttttataaatttattttttttatttgttttttgatttttttttattgaattgatgtaagaataataaagttttaaaatagtatttatatttttttaaagtttgttttaaatgttattttttttagtttgttgttttgttttgatagggtttttttttgtcgtttaggttggagtgtagtggtacggttttggtttattgtaatttttgttttttaggtttaagcgatttttttattttagttttttgagtagttaggattatgggcgtttgttattatgtttggttaatttttgtatttttagtagagatagggttttattatgttgtttaggttggttttgaatttttggatttaagtaattcgtttgttttggttttttaaggtgttgggattataggtgtaagttatggcgtttggtttttattttttttagtgtttttaataaatatagagataaaagtttaaataataatgtaatgaatatttgtataattattattttgattaatattttagtgtgtttgttttatatgtatgtatttacgtatatagttttttttttggtagggggagttagattattttttatttttatttttttgtttagagttttttagtattatagtttgaggttttgtttatagaataatatgaaaataaattatagatattgtgataattttaaaatggttaatttgtattttttgtgaataatgatatttttttttatatttatataagatataagggggttgagtgtggtagtttacgtttgtaattttagtattttgggaggttaagaggggaagattatttgagtataaaagtttgggattaatttgggtaatatcgtatgatttttttataaaaaattttaaaaattagttgattttggtgtcgtatgtttgtggttttagttgtttgggaaatgggaggattgtttgagtttaggagttaaaagttgtagtgagttatgattatattattgtattttagtttgggtaatagagagagattttgttttaaaaaatgtaaattgatgattagaaaaaaattataagtaggttagttacggtggtttacgtttgtaattttagtattttgggaggttgaggtgggtggattataaggttaggaaatcgagattattttggttaatacggtgaaattttatttttattaaaaaatataaaaaaaaaaattagttgggcgtggtggggggggcgtttgtagttttagttattggggaggttgaggtaggagaatggcgtgaattcgggaggtggagtttgtagtgagttgagatttcgttattgtattttagtttgggagattgagtgagattttattttaaaaaaaaaaaaaaaagaaaaaaattataaatagaaagatttttttataatagtaataataattataaaatatttaggaatagttttttttttggttatttatgattttttaattgttaaatgtattggttagttttagttttttttattttatgggattttattagtagtatttgatgaagttgattattttttttttttggaatttttttttaaaaatatatatatatataataaagttttaatagtgaaaataaaaataaataaataaaataaggttttgtttttatttaggttggagtgtagtggtataaattatggttttttgtggttttaagtttaagtaatttttttgttttagttttttaagtgattaggattataggtatgtattgttgtgtttagttaatttttaagtttttttgtagagatgagggtttcgttttgttgtttaggttgattttgaatttttggttttaagtgattttgttgttttagttttttaaagtgttgggattatagttatgagttattgtgttcggtttggaaatattttttttattcgatatttagaatataagtttattggttttgtaattatttttttgtttataattatgtgtgtgtgtgtgtgtgtgtgtgtgtgtgtgtgtgttagttaatattatttataaaataaatataatattattaatatatatattgtaatatttttgtgattatgaattttgttaattgtaatgtttttatgaattttttaggtggtagataaatataatttttatttaataattaaataaatttggtaagaatattgtttttttat

SEQ ID NO: 25 - DNA, 9293 bp, Artificial Sequence
  chemically treated genomic DNA (Homo sapiens)
tttttatgttttttttttggagttttatagttttaggttttaagtttaagtttttaatttattttgggttgatttttgtatatagtataagatgagtttaattttatttttttgtatgtggaaatttattttttttaatatttttatttaaaagattattttttttatattgtgttttttggtattttttttttttttttgagattgagttttgttttgtgtttgaatttttaggttaagaatatttaatggtagtagttatagttgtttaaagttattaatggtatttgggagaaagattagttgaaatgttagttaatgttgttgtggattgtgtttgtatgttttaaaaacgttttgtgggtcgggcgcggtggtttacgtttgtaattttagtatttagggaggtcgaggtgggcggattacgagtttaggagttgagatttgtttggttaatgtggggaaattttatttttattaaaaaatatattaaaaaattagtcgggtacggtggcgtttgtttgttgttttagttattttggaggttgtggtacgagaattgtttgaattcgagaggcggattgtgttattgtattttagtttgggcgatagagtaagatttcgttttaaaaaataaaaaaataaaaatattttgttatttatttattgtgtgtaaagaaatatatattgtaaaattatttatattttgataattaggtgtatttatttttgttgtattaaatgtattataagttgttaattttttatataatatttgtaatgagtattttgtaatatatagattttaattaattatttttttaaggttgaaataattatgtttagtagaagttttattaataaattgtatatgtttttgttatagtatgatgaatatagtgttatatttttttgatgattttagtttattttataagtatgtagtaaaatagttttttttgttaagttgtatatatttgatggtttttatgtttttttagtatgttattttgtttttagattttagatttgtaggaagtatattgatttttatttttgtatttatgatggtttttgtatttcgttttttaggtattaatgaagattataaggggaaatttataattaagtttattaagttgataaatattattttatagaagtagttgagtttgtgtagataaatttatgggttgtgtaattattatttaatgtttagggttttttattttttttgttttttattattttttgggttgatttagtttttttaataaatttgtatgttgttagttagaacgttgttttattttttagttatattagaatttttataggagaaaatttttaaattgaaggagtagtaaaatttttggtaagaaaggattaggtggtagtacgattatgattggttgggtgcgttgtattttgttttttatttgtagttttaaaatttgaaaagtttagaaaattaaaatttttttgtttgtttttttgagacggggttttatttttatttaggttggagtgtagtggtatgattttggtttaatgtaattttcgtttttcgggtgtaagcgattttttagttttagtttttcgagtagttgggattataggtatatattattacgttcggttagtttttgtatttttagtagagatagggtttcgttatgttggttaggttggtttcgaatttttgaatttaggtaatttgtttatttcggttttttatagtgttgggattataggcgtgagttatcgtgtttggttttaaaggtattttttttgaatttagtgtaaatttattttgattagatgttaatagtttttattttattttatgttaatattttttgttttattgtaaaatattagtgtatttgatttaatatttttgtagggggagtgggggtgtttatttaataattaatatatagtatatgtattgtatcgtttttaaagtttcgattttaaattttattattgagacggggttttgttgttgtgttatttaggttggtatgtagtggcgcgattatagtttattaaagttaaaattttgtaggtttaaattatttttttattttagttttttgagtagttgggattataggtgtgtgttattataattagttaatttttgtattttttttattagtttcgttatgtttttttggttggtttcgaatttttgagtttaagtattttagagtattttttaaagtgttgggattataggtaagagttattgcgtttagttagttttaaagtttagaattttttttttaaaaattttttttaaaagttttaaattttgaaatatttggttgttagggttttagataagagattgtggattaaaaattaagatgttttgaaaagtgtttttttttgttttttttttgtgttatttttaggttatgtaggaaaatgggaaattatgttggatttaatgttaaaaaagttagattttttgttttttttatttattttgttgttgttagttgagataggattttattggagtatagtggtatgattttggtttattgtagttttgattttttggtttcggtaatttttttattttagttttttaaatagttgggattataggcgtttggttaatttttttattttttgtagagataagagttttgttatgttgtttaggttagttttaaatttttgggtttaagcgatttatttgtttcggttttttatatttgtattttttaaagtatatttttaagtttagatgaatttaagtttttgtagttagaaattggtagaattggtgtttgaaattttttattttttagtgtttaaattttttattattgtaagatattttttgtgtgggttttttttgtggaaattatatttggagatttttattttttaattttaagtttttttatgatatttatttaggattagttttgtttttttgttgaaggttttaagagatttgttttttttttttcggtagttgttagtatttttattattttatgagtttttttttaagtttggttgtgaaatgtgatatttattagttttcgtagtattttttttttaatttttttgttatatttgatgataattttttaggttttttatatttttaggattttgttattaattattatagggataagtaaaagtaatatatataaaataattgtataatagaataatatagggtagttatatagaatgatttttgttgtttaattttggaaaatgtgattttcgaggatttatattttaatttttgttttttatttttgaggatggagttatcgttttttttttttggttatatatttagatgtattttaggtttgatgatagttgtaatgtaaaaaagaatagtaaggtttttggtttttgtagataatttggattagataatttttagattgggtaatattcggtttattagtgttattggatgggaagttttgattgagttgtttgggtttttggcgtgttgaataaagaattgaataaaacgtagaaataaagtaataaaagaagtaacgaaagataaaataataaaagaacgaagtaataaaagtataaatttattgaagcgaattaagtgttttaagagttttaattgtagtgtttttaagggttattaggttaaaagaatttggtaaatttttaggtgttttttatagtcgtttaattggttgtattttatgaaggattggtttgcgattaattagaggttgaaatggagatggtcgaggataattagaggcgatgtggaaatttttgttttgtaattataggagtgaaggtgtggtttgtatgttgtttagttttgtttagaaattgttgtatttgttgtttttttgtttatgttttaatttttggttattttaattttttatttttttgttttattaggtttttattttgattaaaaatgtatttatttagttgggataaattttatattgtatttgttttatttagatgagtattttagtagagtatatggtatatgagtaggtatttaaaaatttaatatatagtatattttgttatttatgtgttaggtgtcgggtaggttgagttaatagttgaatagaaatttatttatttaacgtgttaatttttatatagtatggtcgtgtatttaaattaaatggaaagcggtatgggagatttggaaaggttttttgtgggtggtatttgattatttaaatttttattttagttttatttattgattttgatatttggaataagtagttttttagtgtttgtttttttattggtaggtaaatgggttaatgacggtatttttggtattagatttcgttaattaatgaaaagtatatagaagaaaatagtttggttttttaagtgggtagtgcgatttttaaggacggtatttcgtttgatagtttttttttaggttgagaagttagagtaaatttatttgatttttttattatatagtgttttttttttagatgagtttaaagttttaagtttatttagttttgtttagacgcgtttgtttatttttaataggtttattagagaggcgggttttttaaagtttggtacggtttattgtaggtgacgttttttgttttttagcgtttttaggtttttggggtttattttttttttttattcgatttcggaattttttttcgcgttttgttcgggcgtttggttgtttggggtagaggtttttcgttatacgcgcggtttcgtttcggtttttacgtgatttggcgtgcggagcgcgtacgcgggaattcgcgttggaggcgggcgagggtcgaggggtagttagggagcgcggtttgaggagggcggggtcgtttcgtaggttcgttagtgtttttagttgttttcgcgcgttaaagttaaatttcgatattcgtcggcgggtcggtgagtttattagttgattcggtaggttaggatttggtttagcggcgtcgcgagttttagtgcgcgtattcgtggtcgttttttagttttttttgtcggacgagttttgggtcgttataagattaaggaatggttatttcgtttaagagaagttgttcgttttttttagttagttttgaggggattcgtattaagaaaatttttatcgaagggaatatcggtaaggagttttcggaaatgtgggacgtaaggttggggtgtcgcggtagtggttgaagttttttttcgtcgtatttttttgtagtaattcggtgagggttttttttttagtttggcggtgtggacgcggtttcggtttttttttttatttagagtattttttttttatttttcgttttacggggtgattgcggttttcggggttagattgggcgttaggtttgcggtttttgtgaggcgcgttttgaatttttgttttttttttgttgggaattcgtaaagggaagcgggggaagggtattagattttttgaggtgtaatttatattaaatttattttttttaggtgtatttttttatgaggtttgataaatattatgttttttgttattattatgatcgagatatagaatatttttattattttagaaagtttttatttgtttttttgtatttagttttttttattttttttattttttggtatttattgatttgatttttatttttgtaagtgttgttttttttagaatgttatataaatggaattataggttatatcgttttttgtgtttggcgttttttatttagtataatgtttttgaaatttatttatgttatttgtgtttgtagtttgtttttttttattgttgagtagtattttattgtatggatgtattatcgtttatttattttttagttgtggattttagggttgtttatagttttttagttatattattagcgaagtattgttttagttatattattaacgaaattcgaaatattcgagtataagtaaagaggtttttaatgattttaatagtatggagttttttattttttattttatatttaagtaaatattggattatgatttaaagattattaacgtttttgttaatttagatggggggtagattaggttatgtttgttattttgtaagatatatattaacgttcgatttttttgtatttttaattataggaaatttatttttgaaattttttgttttgatagatttaaaaaaaaatttttttagttttaggttgggtgttggttatttatgtatatagtaaattttttaaaatttttattatatttaaagtattgtatttttttgaaaaaggttaggtaagtagatgttttaagtatttaaatgaatagaaaaattgtatttttaaagaggattttttattttattgttttagaattaaagtattagtagaaagattatatgatataattagtaatgtaagttatttgagggtgtatgtttattagtatggaatttttgatagttgtttattgaataaagaagattatatataaagataggagaaagtggttgaataaagttatttgaaaagtaaatttgaggtagggtatggaggtttatatttgtaattttaggatttggggaggtttaggtaagaggattatttgagtttaggagttttagattagtttgggtaatatagtgagaatttatttttataaaaaaattaaaaaattagttgtatgtgttggtgtgtttttagttatttaggaggttgaggtaggaggattgtttgagtttaaagattaaggttatagtgagttatgattatattattgtattttagtttgggtgatagagtaagattttgttaaaaatatagaaataaaatagtaaagttgaatgaataatttttcggattaatattataatatatttattttttttttttttttttaatttagttaggtagtattatatttagaaatatttttttaaagtatttttaatttttttagtagttgaaataattttttaatatattattttatttttagttttttttaattatttttgtaacggtttttttgtatgtaaatgttatgtgttattttttgtttaaaattttttattgattttgtttttatttatattgaaagtagttgtgaattgatagtttgtaattgtataatattggtttgtataggttgaaaaaaaattttattggttagtggtttaagtttgtaattttagtgttttgggaggttgaggtaggaggattgtttgaggttaggagtttgagattagtatggtaatatagtgagaattagtttttaagaaaaataaaaataaaattaggttaggtatagtggattacgtttgtagttttaattatttaggcggttgatgttgatgtgggaggattatttgaatgtgggaggtagaagttgtagtgagttgagatggtattattgtattttagtttgggtgatagagttttaaaaaaaaaaaaaaagttagttgtgttagtatgtacgtttagttttagttatttaggaggttgaggtggagatttttgagatttatagtttgaggttgtcgtgagttgtggttgtgttattgttttatagtttgggttatagagtgagattttgtgtttaaagaaaaaaaaattaaatttgttgttaattcgaaaacgttttgagattttttataaataattagatttttggttttttttgaaaaatttgaagatttgttaatatcgggtttgtatttttgtatgataataattggtgtttagatggagtatgttttttgttatttttcgtttttttgatattgagattttgttagttattgtttattattggttttgtatttttgtttatgttttttttattttatttgttagatttaaataagttgtaaatgtataaattgttaagttgtgcgtaaattattttgtaatttttttattttttttagaatttgaattttatttggtcgttttagttttatatttatataatttatttttttatgttttgtgttatttaaatgtttttttatgttagattgatggaggatttatttgttttttattttaatagtttgtttagaatgatttttagtattataatgtttgtttggtattaggaattttgttagtttttatgattttttaaagtattaatattagtgtttttggtttttgtttttttttgtttttatagaaaattaatttattaattagtttattttttagtttttattttgttttaataagttaaggaattagatgtgttagtgtgattgggaattttagttgttattattttgtttgaattaaatgtaattgttattatttttagattttttaagtatgattatatgaatttttttgtttgtaagtagtgttagaagaaagttgaatgttgtagttttaagtgtttttagattttggtggatgtttaatttttttatttgttttttgggtgttatttttgaatattatgttttttttttttttttttatttagtttagtgaatgtggggtgttttttttatatgtttttatttttatttaatatttttttaaatgttgtatagtttttaagtttatattttttatattaaattttggtggttagtgtttttattatgattaaattttattgttatttagtttatcgttaaaagtttttttttttttttttggatatagtttattttgtgttttttttttaaattgtttatttgtgttattttttttattgtttcgtttttgttttttttttgtgtgtaattttttaaagtttttttaggtttttttttttttttattgttttgtttaatgttttagatttaaatatagttttgtaagttaaaggtaagttttttttattttttatggatttaatttataaggaagaggaagttttgtttgtaagtatattgaagttatttatatgtttatttgtgtgtgtgtgtacgtatatatagggaaagagagagaatattatgttaattagagatgtttaatataattatatttggtgattttagatataaagggtgtggtggttattaggagtattatttttaggttaagattgtttttattattaaatataatatattgttaaattaaacgtaataaaaaataaatgtgtttaatgaaattgggtagggagtttttttatttttttttaaagaaatatgaagagaaagtttagaaagttgaatgttttgggttttttatgttgtttgttattgtaaattttgtaaaagttaatgattatttgatattttttttttttgataattttttttttttaattttatttttttttataatagt

SEQ ID NO: 26 - DNA, 9293 bp, Artificial Sequence
  chemically treated genomic DNA (Homo sapiens)
gttgttgtgaggaaagataaaattgaggaagaaaagttgttaggaaaaaaagatgttaagtagttattagtttttgtaagatttataatagtaagtaatataaaaagtttaaaatatttaattttttaaattttttttttatatttttttagaagaaaatgaaaaggttttttgtttaattttattaagtatatttgttttttattacgtttagtttaataatatattatatttaatagtagggatagttttgatttagaagtaatatttttaatggttattatattttttatatttgaagttattaaatgtggttgtattagatatttttggttagtataatgttttttttttttttttgtgtgtgcgtgtatatatatatagatgaatatataaataattttaatatatttataagtaaagtttttttttttttataaattagatttatggggagtagaaagaatttatttttgatttgtagaattatatttaaatttaggatattagatagggtaatagaaaagaagaaaaatttggaagaattttaaagaattatatatagagaaaaaataggagcgaggtagtaaagaaggtgatataggtagatagtttagaagaaaaatataaagtaaattgtatttagaggagaggagaaaaatttttaacgataaattggataatagtgagatttaattatggtaaaaatattggttattaaaatttagtatggagagtgtaagtttagggattgtatagtatttagaagaatgttaagtggaagtgaaagtatatagaaagaatattttatatttattgagttagatggaagagggaaaggagaatatgatgtttagaaatagtatttaaggaataaataaaaaaattaggtatttattagagtttgaaagtatttaaggttatagtatttaatttttttttgatattgtttataagtagaaaaatttatatggttatatttaaaaagtttaagagtaataatagttatatttagtttaagtagagtaataatagttagagtttttaattatattaatatatttagttttttaatttattggggtaaagtgggagttagaaaataagttaattaataaattaattttttatgaaggtaaaggagaataagaattaaagatattgatgttaatattttaaaaagttatggaaattaatagaatttttaatgttaagtaggtattataatgttgaaagttattttgaatagattattaagatgagaagtaggtaagttttttattaatttaatataagggaatatttgagtaatatagaatataagaagatgggttatataaatataaaattaaaacgattaagtaaagtttaaattttaggaaaaatagaggaattgtaaaatagtttacgtatagtttaataatttgtgtatttatagtttatttggatttggtaaataaggtgaaggagatatgaataaaagtgtaagattaataatgaatagtaattaataaagttttagtgttagggagacgaaaaatggtaaggaatatgttttatttaaatattaattgttgttatatagaaatgtaggttcggtgttaatagatttttagattttttaaaagaagttaagaatttaattgtttatgggaaattttaaaacgttttcgagttagtaataaatttaatttttttttttttagatatagggttttattttgtagtttaggttgtagggtagtggtataattatagtttacggtagttttaaattataggttttaaagatttttattttagttttttgagtagttaggattaaacgtgtatgttaatataattggttttttttttttttttgagattttgttatttaggttggggtgtagtggtgttattttagtttattgtaatttttgttttttatatttaagtgatttttttatattagtattagtcgtttgagtagttggagttataggcgtgatttattgtgtttggtttaattttatttttattttttttagagattagtttttattatgttgttatgttagttttaaatttttggttttaagtaatttttttgttttagttttttaaagtattgggattataagtttgagttattggttagtaaaatttttttttaatttgtgtaggttaatattgtgtaattgtaggttattagtttataattatttttagtgtaggtaaaggtaaaattagtgaagaattttaagtaggggataatatatgatatttgtatataaaaagatcgttgtagaagtagttaagagaaattggagatgggatgatatattaggaaattattttagttgttgaaaagattaaagatgttttgaggaaatatttttaaatatgatgttatttaattggattggagagagggaaaggggatgaatgtattgtggtattgattcgaggggttatttatttaattttattgttttgtttttgtgtttttaatagagttttgttttgttatttaggttagagtgtagtagtgtgattatggtttattgtggttttgatttttgggtttaagtaatttttttgttttagttttttgagtagttggaggtatattaatatatgtaattaattttttaatttttttgtggagatgagtttttattatgttgtttaggttgatttggaatttttggatttaagtgatttttttgtttaagtttttttaaattttgggattataagtatgagtttttatgttttgttttaaatttattttttagatggttttgtttagttatttttttttgtttttatatatggttttttttatttagtaagtagttgttagagattttatattagtaaatatgtatttttaaataatttatattgttaattatattatatggtttttttattggtgttttaattttggagtaatgaaataagaagttttttttgagaatgtagtttttttatttatttgaatgtttaaagtatttgtttgtttggttttttttaagaaggtatagtgttttgaatgtggtaagaattttaaaaaatttgttgtatgtatgaatgattagtatttaatttggagttaaaaaaatttttttttaaatttattaaaataggaagttttaggggtaggttttttgtggttggagatatagaagaatcggacgttggtgtgtattttgtaaagtgataggtatggtttagtttgttttttatttgagttaatagaaacgttagtggtttttgaattataatttaatgtttatttggatgtggagtaaggggtgaggaattttatgttattaagattattaaagatttttttgtttgtattcgaatgtttcgagtttcgttaataatatagttaaaataatgtttcgttaataatatagttaaaaaattgtaaataattttgaggtttataattagaaaatggataaacgatggtatatttatgtaatggaatattatttagtaataaaaagaaataaattatagatataagtaatatgaatgaattttaaaagtattatgttaaatgaaagacgttagatataaaaggcgatatagtttatgattttatttatatggtattttggaaaaggtaatatttgtagggatagaaattaaattagtgggtgttagggaataggaagggtggagggggttgaatataaaggagtaggtaggaattttttaaggtgatgaaaatgttttgtatttcgattatggtgatagtaaaaggtataatgtttgttaaattttatagaagagtatatttaaaaagggtgaatttaatgtaagttatattttaagaaatttaatatttttttttcgtttttttttgcgagtttttaataaagagggagtagaggtttaaagcgcgttttatagagatcgtaggtttggcgtttagtttgatttcggggatcgtagttatttcgtggagcgggaggtaagggaaggatgttttgggtgggaaaggaagtcgaggtcgcgtttatatcgttaggttggagggaaagtttttatcgagttgttgtagagagatgcggcgaagggaagttttagttattgtcgcgatattttagttttgcgttttatattttcggaggttttttatcgatgtttttttcgatggagatttttttgatgcgggtttttttagagttggttgagaaagacgggtagttttttttgggcggggtggttattttttagttttgtggcggtttagagttcgttcggtaaagagggttgggaggcggttacgggtgcgcgtattggagttcgcggcgtcgttaagttagattttgatttgtcgggttagttagtgagtttatcggttcgtcggcgggtgtcggggtttgattttggcgcgcggaggtagttgaggatattggcgggtttgcggggcggtttcgttttttttaagtcgcgttttttagttgtttttcggttttcgttcgtttttagcgcgggttttcgcgtgcgcgtttcgtacgttaggttacgtgaaggtcggggcggggtcgcgcgtgtggcggaaggtttttattttaagtagttaggcgttcgggtagggcgcgggaagaggtttcggagtcgggtggggaggaagggtggattttagaggtttgagggcgttggagggtagagggcgttatttgtagtgggtcgtgttaggttttggaaaattcgtttttttagtgggtttgttggagatgaatagacgcgtttggatagaattggatagatttaaagttttgaatttatttggggagaaggtattgtgtggtaggaaaattaaatggatttattttggttttttagtttagaggaagattattaggcgaagtgtcgtttttgggaatcgtattgtttatttagagagttaggttgtttttttttatgtgttttttattaattaacgaagtttagtgttagaaatatcgttattagtttatttatttgttagtgggaaaataggtattgagaggttgtttgttttaagtgttaaagttagtaagtgaaattgggatgggaatttaggtagttagatgttatttataggaggtttttttagattttttatatcgttttttatttgatttggatgtacgattatgttgtatagaagttagtacgttgggtaggtaggtttttgtttagttgttaatttagtttgttcgatatttggtatataggtaataaaatgtattgtatgttgaatttttgaatgtttatttatgtgttatgtattttgttagaatatttatttagatgggataaatgtagtgtaggatttgttttagttagatgagtgtatttttagttagggtaaagatttaatgaggtaagagaatagggaattagggtaattaagggttaaggtataagtaaaagaatagtaggtgtagtaatttttaggtaagattaggtagtatataggttatatttttatttttgtgattataagatagaagtttttatatcgtttttgattgttttcggttatttttattttagtttttgattggtcgtaggttaattttttatagggtgtaattaattggacgattgtaaagggtatttagggatttattaaatttttttagtttagtaatttttaagaatattgtaattgggatttttgaagtatttggttcgttttaataaatttgtgtttttgttatttcgtttttttgttgttttgtttttcgttgttttttttgttgttttgtttttacgttttgtttaattttttgtttaatacgttaaaaatttagataatttagttaagattttttatttagtaatattaataaatcggatattatttagtttggaagttatttggtttaaattgtttatagaaattaaaggttttgttatttttttttatattgtaattattattagatttgaaatgtatttaaatgtgtagttagaaggggaaaacggtgattttatttttagaaataaagagtagaaattaaaatgtgaattttcggggattatattttttaggattaaatagtaagaattattttatgtaattgttttatattattttgttatgtaattattttgtatatattatttttatttatttttatagtgattaatagtaagattttaggaatataagaggtttgaagagttgttattaggtatagtaaggaagttgggagaaaggtgttgcggaagttaataggtattatattttatagttaagtttgggggaaaatttatgaaatggtaagagtattggtagttatcgagaggaggaaggtaagttttttgagatttttaataggaaagtagagttggttttggatggatgttataaagaggtttggggttaaggagtagaaatttttaagtgtggtttttataaaaaagatttatataagaagtattttataatgatgaagagtttaagtattggaaaatgaaagattttaaatattagttttattagtttttggttgtaaaaatttgaatttatttgagtttaagagtatattttgaaaaatataaatgtgggaggtcgaggtaggtgaatcgtttgagtttaggagtttgagattagtttgggtaatatggtaaaatttttgtttttataaaaaatagaaaaattagttaggcgtttgtagttttaattatttgggaggttgaggtgggagaattatcgaagttagggagttaaggttgtagtgagttaagattatgttattgtattttagtgagattttgttttaattaataataataaagtaaatgggggaagtaaagaatttagtttttttggtattaagtttagtataattttttatttttttatatgatttgggggtaatataaggagagaatagagaaaagtattttttaaaatattttgatttttggtttataattttttatttaaaattttggtagttagatgttttagaatttaaaatttttagaaaagatttttagaaaagaaattttaaattttggaattggttggacgtagtggtttttgtttataattttagtattttgggaggtattttggaatgtttgagtttaggaattcgagattaattagggaaatatggcgaaattaatagaaaaaatataaaaattagttggttgtggtggtatatatttgtggttttagttatttaggaggttgaggtgggaggatggtttgggtttgtaaagttttagttttagtaagttatgatcgcgttattgtatgttagtttgagtgatatagtagtaagatttcgttttaataataaaatttggaatcgaaattttagaaacgatatagtgtatatattgtatattaattattaagtaagtatttttattttttttgtagaggtgttaaattaaatgtattaatattttgtagtgaaataaagagtgttaatatgaagtgggataaagattattaatatttggttagaataagtttgtattgaatttaaaaaaaatatttttggggttaagtacggtggtttacgtttgtaattttaatattgtgggaggtcgagatggatagattatttgagtttaggagttcgagattaatttggttaatatggcgaaattttgtttttattaaagatataaaaattagtcgggcgtggtggtgtgtgtttgtggttttagttattcgggaggttgaagttggagaatcgtttgtattcgggaggcggaagttgtattaagttaagattatgttattgtattttagtttggatgagagtgagatttcgttttaaaaaaataaataaaaaaattttggttttttgagttttttaggttttgaaattgtagataagagataggatatagcgtatttagttagttatgatcgtgttgttatttaatttttttttattagaaattttattatttttttaatttgggaatttttttttgtgggaattttagtgtaattaaagaatgagatagcgttttgattgataatatataggtttattaggaaaattaaattaatttagaaaataataaaaagtagaaaaaataagagattttgaatattaagtagtggttatatagtttatgagtttgtttatataaatttaattatttttgtaaaatgatatttattaatttaataagtttggttataaatttttttttgtaatttttattagtgtttagaaaacggggtatagaagttattataaatgtaagagtgggagttagtgtgttttttgtaaatttgaaatttgaaagtaaaataatatattagaagagtataggagttattagatgtatatagtttagtaaagaaagttgttttattatatgtttgtgaagtggattgaggttattaagaaaatgtgatattgtatttattatgttgtaataggagtatgtataatttattagtaaaatttttattaaatatggttgttttaattttagaggaataattaattagaatttgtgtgttgtaaaatgtttattgtagatgttatataagggattaataatttataatatatttagtataatagaggtaaatgtatttaattattaaaatgtaggtaattttataatatatatttttttatatataataaatgaataatagagtgtttttatttttttattttttgagacggagttttgttttgtcgtttaggttggagtgtagtggtatagttcgtttttcggatttaagtaattttcgtgttatagtttttagagtaattgggataataggtaagcgttatcgtgttcggttaattttttaatgtattttttagtagagatggggtttttttatattggttaggtaggttttaatttttgagttcgtgattcgtttatttcggtttttttaagtgttgggattataggcgtgagttatcgcgttcggtttatagggcgtttttaaagtatgtagatatagtttataatagtattggttagtattttaattagttttttttttaaatattattagtgattttgagtaattgtggttattattattaaatatttttaatttgaagatttaaatatagaataagatttagttttaaaaaaaaaaaaaaggtgttaagaaatataatgtgaaaagagtagttttttaaataaaggtgttgggaaaaatggatttttatatgtaggagaatgaaattggatttattttatattatatataaaaattaatttaaaatggattaaagatttaaatttaaggtttgaaattataaaattttaagaagaaaatataggga

SEQ ID NO: 27 - DNA, 17848 bp, Artificial Sequence
  chemically treated genomic DNA (Homo sapiens)
  unsure (2183, 8830, 9169, 9333, 9339, 11774)
taatttaaattagtttttgataagcgagattttattagagagagagagagagaaataatgttttaggtattgagggtttaagaaggtagttattatttattatgtgttatataatgtttattgggtggtaattgtgtggtaggtgtggtaggtggatttttttttttaatttttatttttaggttattggaatttagagtttatattgttaattattttttgatacgtttttttttatgattaggtgtattaatatagtttatttaggggagtagagttattatgggtattatgggaataagggttttattataggaatgatattttttttaaagattgaaggagttggaaaagtgaaagtttgtaaggaattgtgggatattttaagaggagttataaatgggtggaggattaggtgaaatttatttgttgggtatttttgtttgttatagtatttgattagaagatttttatagaggaatggttgatatttttattttgttttttaaattttattttaggtttttttttggttaattttaatttagagttttgttggtagggcgttttggaagtgtattttttaatttaattaaatcgatttagtataatttagtatattataaaatttttaaagtaggtgagatatagttggttaaaagtttaggttgtagaataaagtttgggttatatttttgtatgtttattttttttttttaatggttgtatgatattttaaataatattggttagtattttatgtatacggtagtatttagaaatattggaaaaatagtaaattttttagagttgtattttaaggattaagtagagtgtttggtatgtagtagatgtttagtaaatattggatgaatgaatggatgttgaatgattagagtttttgtaggataatattttgtttaagataaaatcgtttaggggtaggaagtggtttcgtttttttaggtaagggggaggtaattttatttattaatatgttattatttttagttttttggttagtatttaaatgggatgaaaatttcgtgtttattgtttcgaagaggaaatgattattatttttttggggtgttttttttttttatgaagatttttttaattgtatttttttatgtgtaaaagtggggttttaatttttttttttggttatagttgattgaattatgattagatatttgaatatagttgggttaattagatttttttttttgggaatttggaattgggatttaaataaataaaaaatatttaataaaataagtatagataattaaaggggggtagaaagattattattaatgaattaagataattgataggtaatttaggtaaaagatattttagttttttatattatattttatattaaaaaaattttgaatgtttttagaggttgggtgttgtggtttatatttgtaattttagtattttgggaggtagaggtgggtggataatttgaggttaggagtttaagagtagttaggttaatatagtaaaatttcgtttttattaaaaatataaaaaattagtcgggtatggtatatgtttgtaattttagttatttgggaggttgaagtatgagaatcgtttgaatttaggagatggaggttgtagtgagttaagattgttttattgtattttagtttgggtaagagattttgttttaatataagaaaagaaaagaaaagaaaagaaaagaaaagaaaagaaaagaaaagaaaagaaaagaaaagaagtaaattatagagataaaatatttataaaggatttatttagaatatttgaagaataagataagtaaaagataattaatagaaaaatggatataagattttaatagaggatattgaaatgattaataaatatataaaaagatgtttgattttattaattagtaggaaaatgtaaattaaaattataataagttataattatatatagtaaaatggataaaatttaaaaagttgataatattaattgttggtaagaatgtgggaaaattagaatttttttttattgatgatggtaatgttaattagaataaatattgtggaattatttattatttgggaatatttattaaagttgagtatatatatgtaatttattatatagtagttttagttttatttatatatttaagagaaatgtatatttttttntattaaaagatatgtataagaatatttatcgtaatattatttattatggtttaaatttagaaattttcgagtatattgtggtatagtgatatttgtggatattatatagtaatgagaatgagtgaattataattaatatatttaatttggatgaattttatagatatgttaaataaaagaagtatttattatataattttatttatataaagaaaacgtaaaattaatttttattgttgaagttaggttaatggttatttttgagggatagtaattggtaacgaatatgggggattttggagatgcggataatgttgttttttgatttgaatttaggtaatagttattttatttgtgaaaattttattgaattgtatatttataatatatttttttttttttattgtataatatatttttttttttttattatatattatgttttattataattttttttttttttttttttttgagacggagtttcgttttgtcgtttaggttggagtatagtggcgcgatttcggtttattgtaagtttcgttttttcggtttaggttatttttttgttttagttttttgagtagttgggattataggagtttattattatatttcgtttttttttttttttttttgtttagtagagatagggttttattatgttagttaggatggttttgattttttgatttcgtgattcgttttcgttagttttttaaagtgttgggattataggcgtgagttatcgcgttaggttattttattataaaatttttaaaaataatttttaggagttttgttattggtggagggtgtttaggtttttgatattttgaataaagaattggataaaacgtataaagtaaggaaataatgaagtaataaaagtatagatttattgtatattaaagaatatttttttcggtaggaagggtttaagtaagtagtaattatagaattttttggggtttaaatattttttagaggttttttattggttatttggtgtatattttatgtaaatgaagtagtggttagcgattagtttgattggttgtaggaggggattaattagaggttgaagtaaagttatgaagttatattttatgtaattaaagatttggtttgttattagtttgattgattgttcgcggggattagttagaggtatttttaattttttatttgttatttagaagagggattagtttttggtttttttgttatttgggttagaaagttggggttttttttttgatttagttttaggaagttagtttaaatcggttttaggttttttgtttttagattttatttttttgtttcgtagtttttaggagattaatgtttgtttgtagataatttttttatttaatttttataatatttttgaggtagtaagattttggcgaggtagagagttttttaagtttttttggatgaatattttttaagtttgagtttatataggtaaagaaatgtaagtagtttttttttgttttttttttttgttttgttttgttttgttttaatagaagtggttgttggagtggagatgggaatgggtaggattttagtcgttttagtagttattaacgttttattttggttatttttaaaaaattcgattaaaaaaaaagtttttaatatataaatatgattttagttattttatatatatattaatataagaaaaaggtttcgtgttttttatgggaatagttttaagataggtattttagttttcggtttttttttagtttttttgtaattagatttttgttttttaaaatttgttatatttaagagcgttgtttgaaggtcggtttggtttgttgatttttggttttgattgttggtgatttaagcgattggaattggaagtattatttgataatattttgtaaattattatttttgaggttgttatgacgacggggtgtggtagttcggttttatttgtggtagtagtttaggtttttgtttttttgtagagtatattttatcgatagtaggatttaggttttatataagtttttattcgttattgtttacgtttaagaatttaatttattaggtttaaataatttttagttatatatttgagttattattattttattttgaagggatttttgggtataatgtaaatcgattgatcgaatatttatttatttatttaagatataaattaagagatggggtgtaattgattatttaatttgttaatttagttaataatatgttagtattgtgtaggggaattatagggaataggaaaaagttaaatttgtgtaaattattagattgagttatttttttattttaaaatttttattttttttcgatattaaaataaaaattagataataagtatttgggggggggaaatttttttttaaaattataatttttatttttaattttgtttttagttataaaatttattttaaagttatataaaaatgaagtggttggattgtggaattacgttttttaaaatgttatttgtttaatgaataaaaattattcgtatcgtaattttttttattattaaattttgtatcgttgtaaaattttttttatttaacgtttttttataaatatcgcgatagcggagcggttttttgggcgtatttcgtcgtatgtttaattttatttattttttgtttgacgatttttttacgttaacggtgcgttggagcgagtgagtagcgatatttagggcggaagtgttttcggcggaagtgatcgttgtgtgaatcgtgggtgggatggtcgcgggtcgtttttttttaagtcggtttcgagtattttttagttttatggttaagagtttattcgagggcgtttttttttttagaggtttgtacgcggggcgcgggtttcgaaggttttttatcgaaggtaatattggtaagggtcggaaagcggttgttaagttttggttttcgttacgtaggcgatagaggttgggaaaggagttgggttcggaatggtttgcgtttgatgcggtcggtttttttttttgggttgcgaggagagttttttttttcgtaaagtgtattgtgtatttttgtttttttgtttttaggatatcgggttttagtattcgtttataggaatatatttgttggggtataaaagttacgtagttagtggataggataagaattgtattagttgtttgtaatagatcgaaattgaagcgataagcgggtgtagtttatttgtttttttagatagggttgttatatttagtagaaattaaaaataatatttagttaaaatagaatttaagataacgaataatttttagtgtgtgtttaatgtaatatttgggatatttttatagtaaaataataacgaaattatttattgaaagtttaaatttaattgtgttttgtattttatttggtaattttattcgaagagagtttttaaattttagtcgtttaaatattatatttataatttttgttttgtgtttgtgttagttgtataataattttttaaggttttttttagaagaattttattttttaaatttaaaaatatgtattaaattaaaaattattttgttaaaagagtgagatttagtattttgaataaaaagtagttagaaagtaaaatgaaggtaaagtatttcgatttaatattaataaattttgatttgatatttttatttattaagttattgagtttttaaaaggggtttagtaagtgttgagtattgaagacgtagtagtaaattgagaatttttttttttatttatttaataaattattttttgagttatttttatatgttagtattgtttttggtttggagaatatagttgtgaatagaataaataaaaatttttgtttttatggaatttaagtagggagagatggataataaataatataaattaagtaaggtgaataatatgttagagagtaataagtatgatggagaaaaattagggatgaagaattgagggaagtttttattttattttatttgagatggagttttgtttttgttatttaggttggagtgtaatgatacgatttcgatttattgtaatttttgtttttttggtttaagcgatttttttgttttagtttttcgaatagttgggattaggggtattcgttattatatttagttaatttttgttttgttagtagagatagggttttattatgttggttaggttggttttaaatttttaattttaggtgattcgtttgtttcggttttttaaagtgttgggattataggcgttagttattgtatttggtcgaagttgttattttaaataaaataagtaaggttttattgagaaggtgatatttgagtaaaaaattgaagatgagggagtaaattacgtggatatttgggagaagaattttttaggtagagtgaagagtaattggaaaggttttgaggtggaaagtgtgttcggggaataggagggaaatcgttgtgattgaagtcgagtgagtaaggatgggagggaaattagggtaaaagtttaaggggtggttagattttataggttttattatgggtttttaattttatcgagatgggtagttattggaaggtttgaggagttaagtgatagttttatttagattataaaaagattattgtggttgataatattgaaagtgaagagtgttaagtggtattgtaataattatagtattgtgaaaagtgaaagtggtgagacgtgattggattttagttatacgttaataaaaattgagttatattttaagtaaaatttaatagtggaagtggtgagaaatgattgggttttagttatattttaagatagggttaattggatttggtgataggttgaatgtagagtgtaaggtaaagagaggggttaatgatgattttaattattttgatttgagtatttgaaagatagatttttgatttttttttatttttttttttttttttttttttttttttttcgtttttttttttttggtgtggttttgttttgttgttaggttagaatatagtgatgtaattgtattttattgtagtttgttttttaggtttaagttatttttttattttagttttttgagtagttggatttataggtgtttgttattatgcgtggttaattttgtatattttttgtagagatagggttttattatattttttaggttggttttgattttttgggtttaattgatttttttgttttggttttttaaagtgttgggattatagaagtgagttttggttttaagtatgttaggtttttatatgtttattaatatttaagtagaggtgttgaataggtaattggatatgtaagtttagaattagggttttttcggattggagttgtaaatgtaggtggtatttaatgttagagattatgtgttgatggaaaggattgagttttgagtatgtaaatattatgaaattggggagatgggaaggaataagtagagattgttaaggaatgtttattgaggtaggagaaaaaaataaaagagaatgatattttggaagttaagtgaagaaggtatttagtgggagggaatgattagttgtgttatattgtttaagtaaatgaaggtttttggtgaatttgaaaagaatagttttaggagtgttaggagtgaaagtttaattggtataggtttaaggagaatgggaggtgaggagagtgggttaagataattggaagtttttagaaagggaagttatggggtggtagttgaaattagaagagggtgtgagtgtttaatatttttaattttttttttgtgaaaagaattagagtatgtttttaagttgatagaagtggtttagtggaaaggaggaaaattggtaaatcgggatagaggatagaattgttggagtgatttttaagtaagaaagaatggaatttattgtttagtgggaaataatttagttttagttaggagtataatttatttttagtaataggcgtgatggtaaaatatatgagtattaattttagagggtgtggtgggaatttgggaaggttttttggttgtgtttgtttttagagtgaagtaggaagaaaggttattagttaagagtgaatgtagagatagaagatatgaaatattttagtgaataagtaagagaaatgttgaattattgggtattatttaggatttatttggagttagtggttatgaatttaaagtgagattagttattatggttgtgtgtttttttttagttaaattcgaaatattgaaaggaatgggaagggagagttttgttatttgtttgatgatgttattatttaaatatgatgttttgtattgtattttgagaaatatatttttaaaggaagttttgtttttaaattttagagagagaatagggtatgttataaagtaagtatttaggataggttattagataaggtttgaattttttttatttttttgatttttgttttttaattttgttaaatttttttgttttttttttgtttttttgtgtaatagaggtttattgagtgaggattaagagtttatttttatgttgagtatagtagtgaatgggatatagtttttgttttttaaggagtttataatttataattaagtaggagaaaatagattcgatataattntttttttttttttttttttttttttttggagatagagttttgttttggtatttaggttatagtgtagtggtgtgattttggtttattgtagttttcgttttttaggtttacgttatttttttgttttaggtttttaagtagttgggattataggcgttcgttattatgtttagttaattttttgtattttttagtagagacggggttttattatgttagttaggatggttttaattttttgatttcgtgattcgttagtttcggttttttaaagtgttgggattataggcgttagttattgtgtttggtcgattcgatataatttttatattgtgtggngagatttgtgattgggtatggaaagttagaatttttggggtaggaatttttaagaggaagaagagggaaaaagtgttttagttatagaaagtaatatgtgttaaggtggtgaagtttgaagaatatatgtagtttttggggggtttttttgtttgtttgtttgnttggtngaaagaagtttttttttgtatttaggttggaggtaggggggggatttaattttttgtattgtattttgagaaaatatttttaaaggaagttttgtttttaaattttagagagagaatagggtatgttataaagtaagtatttaggataggttattagataaggtttgaattttttttatttttttgatttttgttttttaattttgttaaatttttttgttttttttttgtttttttgtgtaatagaggtttattgagtgaggattaagagtttatttttatgttgagtatagtagtgaatgggatatagtttttgttttttaaggagtttataatttataattaagtaggagaaaatagattcgatataattttttttttttttttttttttttttttttttttttgagatagagttttgttttggtatttaggttgtagtgtagtggtgtgattttggtttattgtagttttcgttttttaggtttacgttatttttttgttttaggtttttaagtagttgggattataggcgttcgttattatgtttagttaattttttgtattttttagtagagacggggttttattatgttagttaggatggttttaattttttgatttcgtgattcgttagtttcggttttttaaagtgttgggattataggcgttagttatcgtgtttggtcgattcgatataatttttatattgtgtggtgagatttgtgattgggtatggaaagttagaatttttggggtaggaatttttaagaggaagaagagggaaaagtgttttagttatagaaagtaatatgtgttaaggtggtgaagtttgaagaaatatatgtagttttttgggggtttttttgtttgtttgtttgtttttttgatggagttttattttgttatttaggttggagtgtagtggtgtgattttattttattgtaattttcgttttttaggtttaagtgatttttttgttttagttttttaagtagttgagattataggtatgtgttattacgtttagttaatatatgtagttttaatgaaagagaagtagttggatgtgtttggagttgaagggatttgtgaaagggtggtagaataagaggttggaagggtgggatttgttatatgtcgaagagttttgtggattatgttagtttattttgttggtagtgggaggttgttgaatatttgaagttagtgtgtgttatgattagattaatttaaaaaaggaaattgtgtaggatgagaaagaaagttttataaaataggtattttttttgtatattttgtttgttgtagtatttatagtgttttgtatttagtttgttggatgaatgaatagatgaattggaatagagttgagtttgtgtattagttttgtggttattggagtaattggagggaggaaagatgtaggtttgaatagaagaattgaaatgatagagaagtgacggttttagagagattttggaagcgggattgataggatgtggtggttatttggaggtgaggtaggaggaggagtagaggagggtgatattgaggtttatgaggatgggaataaaggaagaggcggtttggggaggttagagtgatatgttttgtatgaggtgtttgtgagatatagaggtgttttgagatagattggaatatgtgtttgaggttaagagagttcggagatgggtgttgagattttagatgtggaagttgttgattggtgggtagaggggtagttggtgaagttttggaagtaaatgtaattgtttaagaaaagggtgatgcgaagtggaatgggaggatttaatttgattttttttatttttattttttattattttttattattttatatattttgatgattttttttagatagaattagttattgttttttttgtgggttgatataatattttgtatttataattgttgtagtatttgagttttgttgagtttgtttgtatatttattattttttttgggttttgattatttagtgtgttgtttatttttgtattgttgatatttaattttcgttttgatttagtgtatttagtattgattagatttttgaattttgtgttatgatatttatgtggaagttaggtattggtatttatatagggaatgtattaaattgttttttaaattaagagtgattattttttttaattataggtaatatttttaagtaaattagaatgagagtatttatttaggaaatttgaatagggaaggtgaatttttgttttgattaaaattgggtatgtttagagggttttttttgtattttttttgttttaagttttattattttgattttgaaggtgtagatagcggtatgtaaggaaaattgattagtgaagtagtaattaatggtatttagtatgatttacgaagttatataagatgtgtgattganagttaaaagtttggtatttagaatttttgaaaatttaaaaaataaaatatttagtttgttttttaagattgtttatttttatagtgtattattatttttttgtgattattttacgattataagcgtaaattgaagaaaagattgttgtatgaaattttattgttagtgagttattttagtatttttattttatttttaaagatttaattagaaaagaggaaatttttttgtattttttaattaagaaatttaaatataaagtagtagagggtttttttaataatatgttttttttagtatttaaaattagtgattttatattattaatatgtgttttatttattttgagtataaatgattgggtaaagaatttttgggaaaaaatagtttatttattttaaatattgtatagtggattttttgtgtttgtgatttatttttttttttttattattgtttttatatttaggatgtaaaggtttagtttttgtttttaaaagtgagtttttagtttagttggagggagtgatgagtgaataaataattatagcgtaattttttggtaaattagagtaggtagtaattaattttgtttagagatgaagtggcgttggagagagtttaaggaggttttatagagaaggtggtagtggaaagttgaattatttggtaggtaaggcgggaggaggggatgttagattagtgagggttttttgtgttgagtagatgagtttggattataggaaggtgtgagaaaattttttgttttttttttttcgtaaatagttttttatgaaaaaaggttattaaagtaaaatgtattaagttttttttaagtttgttgattgatttttattaattttgtttagaatgtttttaagtttggagtttgtatgattttgggtatttagttttggggttagaatataatttgagggtaagtttttagtttagattattattttagttatagtatttatttttgagtagttattttataaatatttgttgattgaatgagtgagtgaatgaatgtagtattaaatatagtatttgaaataaagattttaattttttttggaaggattttttaaaaaagatattagatagttttatatgttttgattttgttggattttggtaaaagattttagaattggatttttttttttatgttttttattttgtttaggagatgaaaatgtttagaggtgataaatataggtttttatgaaatatagttgtattagacgtaaaataatgggatttgttattttgggtattatattatatgttattttgttgttagattttagtattatatagttatggtaggtattgttagtttatagaaaattttgtggggagaaaaaaatatgttttaggaaaagatgagtggtaataatagaattttttgttttagtttgtggaatgagaatagtggagttaatgaaaattaatatgttgaagtaatatatttttaagaaagtattttttatttttttttaaggttgtggtaatataataatagagaatattggtggttagggttttaagggaaggtttgatgttgtttgtaagttttgatattttttaaaatttataatattgagagtatattgaaagataggtcgggcgatgtggttaatttttgttattttagtattttgggaggttgaggcgggtagattatttgaggttaggagtttaagattagtttggttaatatggcgaaattttgtttttattaaaaatataaaaattagttaggtgtggtggtacgtgtttatagttttagttattcgggaggttgagaggttggagaattagttgaattcgggagttggaagttgtagtgagtcgagattattttattgtattttagtttgggtaatagagtaagattttgttttaaaaaaaaaaaaaaaaggaaagaaagataatagtagtggttcggcgtagtggtttacgtttgtaattttaatattttgggagattaaggtaggtggatcgtttgaatttaggagtttgagattaatttgggtaatatggtgaaattttgtatttgttaaaaatataaaaattagtcgggcgtggtggtatatatttgtagtggttttagttatttaagaggttgaggtaggagaatcgtttgaatttaggaaatagaggttgtagtgagtcgagattgtgttattgtattttagtttgggtaatagttagattttgttttaaaaataaataaataaataaataaataatatattggataggttaaatatattggatagttatttaggaggttgaggtgagaagattatttgagtttaggaggtagaggttgttgtgagttaagattatattattgtattttagtttgggtgatagagagagatttttattttaaaaggaaagatagtagttaagttgggatttaattaaattgtagtaagtttgagatagtgatattataagagattggttgaagaagtatggttttttgtagataggggtgttttggttattaggaggaggtttttgaagtaatggagagtaaaatattattatttttaggaattttttgtgaatattttgaaatatttgttaaaataaataaataaataatattttagtaagaagggaaaaaaaaaatttatgatgattaggtattatagtattgagaaagttatattgtgtttggttttaataaaattatgtaattttgaattattttttaaagtaattattttatatttgtgggtggtatttggtatagtttagttttagtggaattagtttaagaaatattgttttgtagtgaattatttaggttttttaaggttgagaaatatggatggtatagtttttaggatattttattattatttattgttattgtatgttgaagttgttttgtgattattaaattagttttttagaagttttggaatggggtatgggttatagagtattttgagtattaggtgttattgttttagttattggaattgtatattttttgttatatttaatttgttggtattttagaattaatgtgtttaaattgtatgagttaattttttggagttttgattgtttttagatgaattaatagtgtttgattttagagttttttttttttatttgtaatagttttttaaggtaattgtttttaatttttaaaaaatataagtaattttaataattgtttaattttagttatttaataaattagttacgtttatttttttatttaattaaaatagttttttagttattaaatagtagggattatattttagatttgttaaataatttataatttaaatattgattatttgggttaaatattttaagcgagggtttatttagggtagataggtatttgataatatatatatttaattatttcgtatttgattagtgtggtaggaatttagagttagagaagttttgaagaagtggtattttaggtttgttgggggaaaggatttagatataggtttggaagagtaggggagggtatttatttattggagtgtgggaagagtagggatcgaatagatgtgaagaagtatatataagttaggtggaggtggggattgagagatgagcgtgattgtataaatttatagatttatgttgtttgtttttattttgtttatttagagaggagttggggtggtatgtagtaaatgttatttattaaatgtgtgggtttttatgttgagatattagtattttaattagtaattataagtggaaggatgtttttttttttttttttgagaaagattatttttgatagaggagattgaggtttagatatagttttaagatttattttttattttttataaatgtaggttttagagggaattgaaattagtaatatattgtgtattttatttatttagttaggttattaggttgtaatttgttttttattttggaggagttttattttttagttggagaaatataatgataattgtagtgatggagttttatttagaatattaattatgtagaaaggaggattagttaatttagtttagaggtgttaggatttggaaaggttttatataggaggtttatttaaatagaattttgaggattgagtaagagttggttaggtgaggagaggaggcgttttaggaaatgggaaagtatatgtaaagttatatttgtaagagaatatggtatgattggagtttggttttgtaggagggtaggttatttaaaggaaagttaaggttagagaggtatatatagggattagatttttttgtgttttgtagattatgttaaagagtttggagtttgttatgaagtttgtttaggttttagtttagatgttattaattttttattgtatttagaatagaatttagattttttattatggttataaggttttatgtgatttggtttcggattgtttatgtggttatatttattttgagttatttttttattgtttgtttttgttatagttagttagtcgatagagagttgttaaaagattgtaagtagtgttattttatatttagtttggttatagtatggagtatggattgaagagagtaaggttagtattagaaaggtaagagatgataagaggttggttttgagtatggaggtgggaatggagagaaaaggataaatatgaaaaatgtagaagtaaatgtagaaggatttggtggttattgaggtttggtagaggagggatttttgttagtgagtggatggtgtgtttatattttgaggtttgggatataggaggaagtttaatttggtgggaaagatgattagtttatttaggaaatatgttgattttgaggtgtttgtggaatgttttaagtggagatgtttggagagtttttgaatagtttttggagtttatggaggtatgggttaaatattggtataaatgggaaaagataatttgaatgttgtggtattaggttgattttatttttaaaatatttttcgaaataattattattttttatttttttgttattatttcggggtaagttgttatattttttaattagtttgtttgtttttgttttagtttatttttatatagttagtggagtgattttttaaaaatgagaaggagttttataatttttttatttaaaattaatttttattaattttttattgtttttagaatagaatttagtttttttattataattataaagttttgtatgatttggttttggattttttgtttggttatatttatgttgagttatttttttattatttgtttatgttgtagttatattgtatggttttttttagggttttaaatttttgtattgttgtgtgttaagtttttttttttttttaggtttttgtatatgttattttttttgtatgaattgttattttttaggttttattttagatgttatttttttaagggagttttttttgattttttgggttatattagtgttattttgtatttttttttagtatttaatataatatgttagtagttaattgtgcgtttgtattatttatataagttttgtgacgataaaatttattttgtgttttgtttattattgtatttatagtttttgatagttttgagtttatagttagtattttatgaatattttttagatttgttgaatgaatgagattataattatttttattttttgttttgaaaaatttagaaattttatattgttatagtataaatagaatggtgatttaagtgatagaatttatggagttgattttatttatttttatatttttaattgttattaaatgttttgtttttggaaggttgagatatggaaattgtaaattaaattttaaaaggaattttttttttttattggttgtatttattatggtagttttggttagtatgaattgatttgttattagtttgataatggtacggttgttgagtttgaaatttagaaaattaatatttgtttttttgagtttgggcgtttgtggtagagtttagtagtagtttttttttttagttttgatttgggaagtattttaatatatgttatttgtattgtagt

SEQ ID NO: 28 - DNA, 17848 bp, Artificial Sequence
  chemically treated genomic DNA (Homo sapiens)
  unsure (6075, 8510, 8516, 8680, 9019, 15666)
gttgtaatgtaaatagtatgtattgggatgttttttaaattagggttgaaggagaaggttgttattaaattttgttataaacgtttaaatttaagggaataagtattagttttttgaattttaaatttagtagtcgtattattgttagattgataatagattaatttatgttaattagaattattataatgaatatagttaatagggaggaaaaattttttttaagatttaatttgtaatttttatgttttaattttttagaggtagagtatttaataatagttgaaaatgtaaaagtagatgaaattagttttataagttttattatttgagttattattttatttgtattgtgatagtgtaaaatttttaagttttttaagataaaaaataaaaatgattataattttatttatttaataaatttaaaaaatatttatggagtgttgattatgagtttaggattgttaggaattgtgggtataatggtaaataaaatatagaatggattttgtcgttatagagtttgtatgggtgatataaacgtataattaattattaatatattgtgttaggtgttaggaaaaaatgtaggatggtattaatatagtttaggaggttagaggagatttttttgaaaaaatgatatttgaggtaagatttaaaagatgataatttatgtaaagggagtagtatatgtaaagatttgaaagagagaaagaatttgatatataataatatagaagtttgaggttttagaagaagttatatagtatggttatagtatgagtaagtgatggagaagtggtttaatatgggtgtggttagatagggagtttagggttaggttatatagggttttgtagttatggtaagaagattgaattttattttaagggtaatgggaagttagtgaagattggttttaagtaggaaaattataagatttttttttatttttagaagattattttattagttgtgtaagaatgggttgaagtagaagtaggtagattagttaaaagatatagtagtttgtttcgaggtgatggtagaggagtgaaaagtagtggttgtttcgagaaatattttggagatgaaattaatttagtattataatatttaagttatttttttttatttatattaatgtttggtttatatttttatgagttttagagattatttaagaattttttagatatttttatttgggatattttataaatattttaaagttaatatattttttaaatgaattaattattttttttattaaattgagtttttttttgtattttagattttagggtatgaatatattatttatttattgatagaagttttttttttgttaaattttagtggttattaaatttttttgtatttgtttttatattttttatatttgtttttttttttttatttttatttttatgtttaagattagttttttattattttttgtttttttgatgttggttttgttttttttaatttatgttttatattgtggttagattgaatatgaaataatattgtttataattttttgatagttttttatcggttaattggttatagtaagggtaagtaatggaggagtggtttaagatgggtgtggttatatgggtagttcggggttagattatatagggttttgtggttatggtaagaggtttgaattttattttaagtgtaatgggaagttagtgatatttgagttaagatttgaataagttttatgataaattttaaattttttaatatggtttgtaagatataagaagatttgatttttgtgtatgtttttttggttttggtttttttttaggtagtttatttttttgtaggattaaattttaattatgttatgtttttttgtaaatatgattttgtatatgtttttttattttttgaagcgttttttttttttatttgattaatttttatttaatttttaaggttttgtttagatgaattttttgtgtgaagtttttttagattttgatatttttaagttggattagttagtttttttttttgtatggttggtattttgggtgagattttattattgtaattgttattgtgtttttttagttagaggatggggtttttttagggtagaaaataaattataatttaatgatttagttgaatgaataaaatatataatatattattaattttagttttttttgaaatttatatttgtgaaaaataaaaaataaattttaagattgtatttggattttaattttttttattagaagtaattttttttaagggaaagaaggggggtatttttttatttatggttattgattggggtgttgatgttttagtataagaatttatatatttaatagatgatatttattatatgttattttaatttttttttgaataggtaggataagaataaatagtatgaatttgtggatttgtatagttacgtttattttttagtttttatttttatttaatttgtgtgtgtttttttatatttgttcgatttttgttttttttatattttaatgaataaatgtttttttttgtttttttaggtttgtgtttaaatttttttttttagtaagtttaaggtgttatttttttaggatttttttagttttgaatttttattatattggttaggtgcgaagtggttgaatgtgtatattattagatatttgtttgttttgagtaagttttcgtttaaaatatttggtttagatggttaatatttagattgtaggttgtttaataagtttaaaatatggtttttgttatttaatagttaaaaagttattttaattaaatgaaaagataaacgtagttgatttgttagatggttgggattgaataattgttagaattatttatattttttaaaagttaaaaataattattttaaaaaattgttgtagatggaaaggaagggttttgaggttagatattattagtttatttaagagtagttaggattttaagaaattgatttatgtaatttaaatatattaattttagaatgttaataaattagatgtaataggaaatatatagttttaatgattggaataataatatttaatatttagggtattttgtaatttatgttttattttaaggtttttggaaagttagtttagtaattataaggtagttttagtatataatgatagtaaatggtggtgaaatgttttgagagttgtgttatttatgttttttagttttggagagtttgggtaatttattatagggtagtattttttaaattaattttattggaattgagttgtgttaggtattatttatagatgtggaataattattttaaaaaataatttaaagttatatggttttattaaagttagatatagtataatttttttagtgttgtgatatttgattattatagattttttttttttttttttgttggggtgttgtttgtttgtttgttttgataaatgttttaagatgtttatagggggtttttaagagtggtggtgttttgttttttattgttttagaagtttttttttagtgattagaatatttttgtttatagaaagttatatttttttagttaattttttatgatattattattttagatttattgtaatttagttagattttagtttagttgttatttttttttttgagatgggggtttttttttgttatttaggttggagtgtagtggtgtgattttggtttatagtaatttttgttttttgggtttaggtgatttttttattttagttttttgagtagttgtttagtatgtttgatttgtttaatatattgtttgtttgtttatttatttatttttgagatagagtttagttgttgtttaggttggagtgtagtggtataatttcggtttattgtaatttttgttttttgggtttaagcgatttttttgttttagttttttgagtagttgggattattataggtgtgtgttattacgttcggttaatttttgtatttttggtagatatagggttttattatgttgtttaggttggttttaaatttttgagtttaagcgatttatttgttttggttttttaaagtgttgggattataggcgtgagttattgcgtcgggttattgttgttatttttttttttttttttttttttttttgagatagagttttgttttattgtttaggttggagtgtagtggggtgatttcggtttattgtaatttttaattttcgggtttaattgattttttagttttttagtttttcgagtaattgggattataagtacgtgttattatatttgattaatttttgtatttttagtagagatagggtttcgttatgttggttaggttggttttgaatttttgattttaggtgatttgttcgttttagttttttaaagtgttgggatgataggggttagttatatcgttcggtttgttttttaatatatttttagtattatgaattttggaaggtattagaatttataagtagtattaaatttttttttaggattttggttattagtgttttttgttgttatattgttataattttaaaaaaaggtggaaggtatttttttaagagtatattattttaatatgttgatttttattagttttattatttttattttataagttgggataaagagttttgttgttattatttatttttttttaaggtatgtttttttttttttataaaattttttataaattgataatgtttattatagttatgtaatgttaaaatttagtagtaagatagtatatgatgtaatatttaaaataatagattttattattttacgtttaatatagttgtattttataggagtttatatttattatttttaggtatttttattttttgaataagatgaaaaatatgagaaaaaaaatttaattttgaaattttttattaaaatttaataaagttagaatatataaaattgtttaatgttttttttaaaaagtttttttaaaaaaaattgaagtttttattttagatattgtatttgatgttgtatttatttatttatttatttaattaataaatgtttatggagtagttatttagaggtaagtattataattgaaatgatgatttaggttgagagtttgtttttaagttatattttaattttaagattgagtatttaggattatataggttttaagtttaaaggtattttaggtaaagttaataaaaattagttagtaggtttaaaaaaaatttaatatattttattttgatgatttttttttatgaaaaattgtttacgaaaaaaaaaaggtaaaaaatttttttatatttttttatgatttaaatttatttgtttagtataaaagatttttattgatttgatatttttttttttcgttttgtttattaggtgatttagttttttattgttattttttttgtgaagtttttttgaattttttttagcgttattttatttttaggtagagttaattattgtttgttttggtttattaaaggattacgttgtaattatttgtttatttattattttttttagttagattgggagtttatttttgaagatagagattgaatttttgtattttgagtatgagaatagtgatggagggaaggaggtgagttataggtatagagaatttattatatagtatttgaaataaataggttatttttttttaaggattttttgtttaattatttatatttaaaataagtaagatatatattagtgatgtgaagttattaattttgaatgttggaggaaatatgttattagggaagttttttattgttttatgtttaagttttttgattgaaaagtgtaaaagagtttttttttttttggttgggtttttgaaaataaggtaaaaatgttgagatgatttattgatagtgagattttatatagtaattttttttttaatttacgtttgtaatcgtaagataattataagaagatgataatatattgtagggatgaatagttttaaaagataggttaggtgttttattttttagatttttaggggttttaggtattaagtttttgattnttaattatatattttatatggtttcgtaagttatgttagatgttattagttgttattttattgattaattttttttatatgtcgttgtttgtatttttaggattagaataataggatttagagtagaaggaatataagaaaagttttttaaatatatttaattttggttaggataggggtttattttttttgtttaggttttttgaatgggtgtttttattttgatttgtttgaggatgttatttgtgattagagaagatgattatttttgatttaaaaagtagtttaatatattttttgtgtgggtattaatgtttaatttttatatggatattatagtataggatttaagaatttggttagtattgagtatattgggttaaggcgggggttaggtgttagtaatataaagatgaatagtatattgagtggttagagtttaaggaaggtggtgaatgtgtaaataagtttagtagaatttaagtgttgtagtagttgtgggtataaaatgttatgttagtttatagaggaggtagtgattaattttgtttagggagagttattagggtgtgtggggtgatgaagagtagtgggagatgaaagtaaaaagagttagattaggtttttttattttatttcgtattattttttttttgggtaattgtatttatttttaaggttttattaattatttttttatttattagttaataatttttatatttgaaattttagtatttattttcggatttttttgattttaggtatatattttaatttgttttagaatatttttatgttttataggtattttatataaaatatattattttaatttttttagatcgtttttttttttatttttatttttatgaattttagtgttatttttttttatttttttttttattttatttttaagtggttattatattttgttaatttcgtttttaaaatttttttgaaatcgttatttttttgttattttagtttttttatttaggtttgtattttttttttttttaattattttaatagttataaaattagtgtatagatttaattttgttttaatttatttatttatttatttaataaattggatgtaaggtattatgggtattgtagtaaataaaatatataaagaaagtgtttgttttatggagtttttttttttattttatataatttttttttttaaattaatttggttatggtatatattggttttaagtgtttaatagttttttattgttaataggataaattagtatggtttataaggtttttcgatatatggtaaattttatttttttaattttttgttttgttatttttttataggtttttttaattttaggtatatttaattattttttttttattaaaattgtatgtgttagttaggcgtggtggtatatgtttgtagttttagttatttgggaggttgagataggagaattatttgaatttgggaagcggaggttgtagtgagatgagattatattattgtattttagtttgggtgatagaatgagattttattaaaaaaataaataaataaataaaaaaatttttaaaaaattgtatgtgtttttttaggttttattattttggtatatgttgttttttatggttgaaatatttttttttttttttttttttgggaatttttattttagagattttggttttttatgtttaattataaattttattatatagtatgaaaattatgtcgagtcggttaggtacggtggttaacgtttataattttagtattttgggaggtcgaagttggcggattacgaggttaggagattgagattattttggttaatatggtgaaatttcgtttttattaaaaaatataagaaattagttgggtatggtggcgggcgtttgtagttttagttatttgggagtttgaggtaggagaatggcgtgaatttgggaggcggaggttgtagtgagttaagattatattattgtattgtagtttgggtgttagagtaagattttgttttaaaaaaaaaaaaaaaaaaagaaaaaaaaaaagaaaattatgtcgaatttgtttttttttatttagttgtgagttgtgagttttttgaaggataggagttgtattttatttattgttgtgtttagtatgagagtggatttttagtttttatttagtaagtttttgttgtataagaaagtaaggaagaagtagagaaatttgataaggttaagaagtaaaagttaggaaaatagagggagtttaaattttatttgatgatttgttttaagtatttattttgtgatatattttgttttttttttgggatttgaggatagagttttttttaggggtgtttttttaaagtatagtataaaaagttagattttttttttgtttttagtttgggtatagaaaaaggttttttttnattaantaaataaataaataaaaaaattttttaaaaattgtatgtgttttttaggttttattattttggtatatgttgttttttatggttgaaatattttttttttttttttttttttgggaatttttattttagagattttggttttttatgtttaattataaattttnttatatagtatgaaaattatgtcgagtcggttaggtatagtggttaacgtttataattttagtattttgggaggtcgaagttggcggattacgaggttaggagattgagattattttggttaatatggtgaaatttcgtttttattaaaaaatataagaaattagttgggtatggtggcgggcgtttgtagttttagttatttggaggtttgaggtaggagaatggcgtgaatttgggaggcggaggttgtagtgagttaagattatattattgtattgtagtttgggtgttagagtaagattttgtttttaaaaaaaaaaaaaaaaaaaaaaaaaganaattatgtcgaatttgtttttttttatttagttgtgagttgtgagttttttgaaggataggagttgtattttatttattgttgtgtttagtatgagagtggatttttagtttttatttagtaagtttttgttgtataagaaagtaaggaagaagtagagaaatttgataaggttaagaagtaaaagttaggaaaatagagggagtttaaattttatttgatgatttgttttaagtatttattttgtgatatattttgttttttttttgggatttgaggatagagttttttttaggggtgtgttttttaaagtataatataaaatattatatttaaataataatattattaggtaaatagtaggattttttttttttattttttttaatgtttcggatttggttggagaaaaatatatagttatggtgattggttttattttaaatttatgattattaattttaagtgggttttaaatggtatttagtaatttaatattttttttgtttatttattagagtattttatgttttttgtttttatatttatttttagttgatgatttttttttttattttattttgaaaatagatataattaaaagatttttttaagtttttattatattttttgaagttggtgtttatatattttgttattacgtttgttattagggatgaattgtgtttttagttaagattaaattattttttattgggtaatagattttatttttttttgtttaaaaattattttagtaattttattttttgtttcgatttattaattttttttttttttattagattatttttgttaatttaaaaatatgttttaattttttttataaaaagaaaattaaaaatgttaaatatttatatttttttttaattttagttattattttatgatttttttttttaaaaatttttagttattttaatttattttttttattttttattttttttgaatttatattaattaggtttttatttttaatatttttaaaattgttttttttaagtttattaaagatttttatttatttaaatagtataatatagttgattatttttttttattgaatattttttttatttggtttttaggatattatttttttttgttttttttttttattttagtaggtattttttaatagtttttgtttatttttttttatttttttagttttataatatttgtatgtttagggtttagttttttttattaatatatagtttttggtattaaatattatttatatttatagttttagttcggggagattttaattttgaatttatatatttaattatttatttaatatttttatttggatattaataggtatgtaaaaatttaatatgtttaaaattaaggtttatttttgtaattttagtattttgggaagttaaggtaggaggattaattgagtttaggagattaagattagtttggaaaatatagtgagattttgtttttataaaaaatatataaaattagttacgtatagtggtaaatatttgtggatttagttatttaagaggttaaggtgggaggatggtttgagtttgggaggtaggttgtagtgagatgtaattgtattattgtattttagtttggtaatagggtaagattatattaaaggaggggaagcgaggggaggggaggaagaaggaaaggaggaaataaaagaaaattaggagtttattttttaagtatttaagttaaaataattggagttattattggtttttttttttattttatattttgtatttaatttgttattaaatttaattggttttattttaaaatataattagaatttaattattttttattatttttattgttaaattttatttaaaatgtaatttaatttttgttaacgtataattagaatttaattacgttttattatttttattttttataatattataattattgtaatattatttaatattttttatttttaatgttattagttatagtgatttttttataatttaagtaaaattgttatttgattttttaaattttttaatggttatttatttcggtaagattaaaaatttatgataaggtttataaaatttggttattttttgggtttttgttttaattttttttttatttttgtttattcgattttagttataacgattttttttttatttttcgaatatattttttattttagggtttttttaattgttttttattttgtttagaagattttttttttaggtatttacgtgatttgtttttttatttttagttttttgtttagatgttatttttttagtgaggttttgtttattttatttaaaatgataatttcggttaggtgtagtggttaacgtttataattttagtattttgggaggtcgaggtaggcggattatttgaggttaggagtttgagattagtttggttaatatggtgaaattttgtttttattaataaaataaaaattaattgggtgtggtggcgggtgtttttaattttagttattcgggaggttgaggtaggagaatcgtttgaattagggaggtagaggttgtagtgagtcgagatcgtgttattgtattttagtttgggtaataagagtaaaattttattttaaataaaataaaataaaaattttttttaattttttatttttaatttttttttattatatttattattttttaatatattgtttattttgtttaatttatgttgtttattgtttatttttttttatttgagttttatgagagtagagatttttatttgttttatttatagttgtattttttaggttaagaatagtgttggtatatggaagtggtttaaaaggtgatttgttgaatgaataaaaaaagaaatttttagtttgttgttacgtttttagtatttaatatttgttaagttttttttaggggtttagtgatttggtagataaaagtattaagttagaatttattaatattaaatcgaaatgttttgtttttattttgttttttgattattttttatttaagatattggattttatttttttaataaaataatttttaatttaatatatgtttttaagtttaaaaagtgaggtttttttaagaaaagttttaagaaattattatgtaattagtataggtatagggtaaaaattgtgaatgtggtatttgaacgattgaaatttaggaatttttttcgaatagggttgttagataaaatataggatatagttaaatttgaatttttaatgagtgatttcgttgttgttttgttgtaaggatgttttaaatattgtattggatatatattaaaaattattcgttattttaaattttattttaattggatattatttttaatttttgttaaatatggtaattttatttaggagaataaataaattgtattcgtttgtcgttttaatttcgatttattataaatagttaatataatttttgttttatttattaattgcgtggtttttatgttttaataaatatgtttttgtgggcgggtattgaggttcgatattttaaaaataaggaggtaaagatatatagtgtattttgcgaggggaaaggtttttttcgtagtttagaaaaagaggtcggtcgtattagacgtaggttatttcgggtttagttttttttttagtttttgtcgtttgcgtggcggaggttaaggtttggtagtcgtttttcggtttttattaatgttgttttcgatggagagttttcggggttcgcgtttcgcgtgtaggtttttggaggaggaaacgttttcgagtgggtttttggttatggaattgaagggtgttcgaagtcgatttagaaagaggcggttcgcggttattttatttacgatttatatagcgattattttcgtcgagagtattttcgttttaggtatcgttgtttattcgttttagcgtatcgttgacgtaaggagatcgttagataggaagtgggtggggttgaatatgcgacggggtgcgtttaagagatcgtttcgttatcgcgatgtttgtaaagaagcgttgagtgaaggaagttttgtaacggtgtagaatttgatagtaaaaggagttgcggtgcgagtggtttttgtttattggataaataatattttaaaagacgtaattttataatttaattattttatttttgtataattttaaaataaattttataattgaagataaaattaaaaatagaaattgtaattttaagaggggattttttttttttaggtgtttgttgtttggtttttattttaatatcggaagaaaatggaagttttaaagtaggaaaatgatttaatttgatgatttatataaatttaatttttttttattttttgtaatttttttgtataatgttggtatattattgattaaattaataaattagataattagttatattttattttttagtttgtgttttgaataagtaaataaatgttcggttaatcgatttgtattatatttaaaaatttttttaggataaggtggtggtggtttaggtatgtgattggaaattgtttaaatttggtaggttgggtttttggacgtaagtaatggcgagtagagatttgtataaaatttgagttttgttgtcggtgaagtgtgttttgtaggagggtagggatttaagttgttgttataggtgaagtcggattgttatatttcgtcgttataataattttagaagtaatgatttataaaatgttgttaaatggtgtttttagttttaatcgtttaaattattaatagttaaaattaggagttaataggttaaatcggtttttaggtagcgtttttaggtgtggtaggttttagaagataaggatttgattgtaagggggttggggaggggtcgggggttgggatatttgttttgaagttgtttttataaaaagtacgggattttttttttatgttgatgtatatataggatggttgaggttatgtttatatattaagaattttttttttaatcgaattttttaaggataattagggtggggcgttaatggttattggagcggttaaagttttatttatttttatttttattttagtagttatttttgttaaaataaaataaaataaaataaaaaaaaaaaataaaaaaaaattgtttatatttttttatttatgtaaatttagatttggaaaatatttatttaaaaaagtttgagaggttttttgtttcgttaggattttgttgttttaggggtgttgtgaaagttaaatgaggaagttgtttgtaggtaggtattaattttttaaaagttacgaggtaggaaaatagggtttggagatagggaatttaaggtcgatttaggttgattttttagaattaaattaaaaggaaaattttaattttttagtttaagtaataaaaggattagaagttaattttttttttgggtggtagataaaaaattgaaagtatttttgattggttttcgcgggtaattagttaggttggtggtaggttaagtttttagttgtatggggtataattttataattttattttagtttttgattggtttttttttgtaattaattagattgatcgttggttattattttatttatatagggtgtatattaggtaattaatgggaaatttttagaaggtatttaaattttagaaaattttgtaattgttgtttgtttgggttttttttatcggaaggagtgttttttgatgtataataaatttgtgtttttgttgttttattgtttttttgttttgtacgttttgtttaattttttgtttaaaatgttaagaatttgggtattttttattagtaatagagtttttaaaaattatttttaaaaattttatggtgaagtggtttggcgcggtggtttacgtttgtaattttagtattttgggaggttgacgagggcggattacgaggttaggagattaagattattttggttaatatggtgaaattttgtttttattaaatagagagaaaaaaaaaaaagcggagtgtggtggtgggtttttgtagttttagttatttaggaggttgaggtaggagaatggtttgaatcggggaggcggagtttgtagtgagtcgagatcgcgttattgtgttttagtttgggcgatagagcgagatttcgttttaaaaaaaaaaaaaaaaaaaaaattatggtaaagtatagtatgtagtgaggaaaagaggatgtgttgtgtagtgaggaaaagaggatgtgttgtaagtgtatagtttaatgaagtttttataaatggaatgattgttatttggatttagattaagaaatagtattattcgtatttttagaattttttatattcgttgttagttattattttttaaagataattattagtttgattttaatagtagagattagttttgcgttttttttatataaatggaattatatagtaaatattttttttatttaatatatttgtgagatttatttaggttgaatgtattagttgtagtttatttatttttattgttgtatagtatttataaatgttattatattataatgtattcggaagtttttagatttgagttataatgaatagtgttgcggtaaatatttttgtatatgttttttggtanaaagaagtatgtattttttttgggtgtataagtaagattggaattgttgtgtaataagttatatatatatgtttagttttgatagatatttttaaatagtagatagttttatagtgtttgttttagttgatattgttattattagtgagagagagttttggtttttttatatttttattaatagttgatattgttagttttttaaattttatttattttgttgtgtgtaattataatttattgtggttttaatttgtatttttttgttgattaatgaagttaaatatttttttgtatgtttattggttattttagtattttttgttgaagttttatgtttatttttttattggttgttttttgtttgttttattttttaaatattttggatgagttttttgtgaatattttatttttgtggtttgttttttttttttttttttttttttttttttttttttttttttttttttttttttttttttttttttgtgttgagatagagttttttgtttaggttggagtgtagtggggtaattttggtttattgtaatttttattttttagatttaagcgatttttatgttttagttttttaagtagttgggattataggtatgtgttatgttcgattaattttttgtatttttagtagagacggggttttgttatgttggtttggttgtttttgagtttttggttttaagttatttatttatttttgttttttaaagtgttgggattataggtatgagttatagtatttagtttttaaaaatatttaaaatttttttgatgtagagtgtaatgtaagaaattaaaatattttttgtttaagttgtttgttagttattttaatttattagtaataatttttttatttttttttagttatttatgtttgttttgttaaatgttttttatttatttaggttttaattttaaatttttagaagggagaatttgattggtttagttgtgtttaggtatttaattatggtttaattagttgtggttaaggaagagggttggggttttatttttgtatatgaggaagtataattaaggggatttttatgaggaaagaagatattttaaagaggtggtgattatttttttttcgaagtagtaaatacggagtttttattttatttgggtgttagttagaagattgaaagtagtggtatattggtgagtagaattattttttttttatttgggagaacgaggttattttttgtttttgggcgattttgttttgggtaaaatgttgttttgtaagaattttagttatttagtatttatttatttatttaatatttgttgagtatttattgtatgttagatattttgtttagtttttgaagtgtagttttgaaggatttattatttttttagtgtttttaaatgttatcgtatatataaaatattgattaatattatttaaaatgttatgtagttattaaaaaagggagataaatatataaaaatgtggtttaaattttattttgtagtttggatttttagttagttatattttatttattttgaagattttataatgtgttggattgtgttaaatcgatttggttaaattggaaagtatatttttagaacgttttattaataaggttttgagttagagttggttaaaagaggatttggggtgagatttggaaggtagagtgggagtgttagttatttttttgtggaaattttttagttagatgttatgatagatagaggtgtttagtagataggttttatttagttttttatttatttgtgattttttttggagtattttatagttttttgtagatttttatttttttagtttttttagtttttggggaaagtgttatttttgtaataaagtttttatttttataatatttataatggttttgtttttttgaatgaattgtattgatatatttaattataaagggagacgtattaaaaggtggttaatagtgtgggttttggattttagtgatttgggggtgaggattaagagagagaatttatttgttatatttgttatatagttattatttaatagatattatataatatataataagtaatggttgtttttttaggtttttagtgtttgggatattgtttttttttttttttttttgatagggtttcgtttgttagaggttggtttgaatta

SEQ ID NO: 29 - DNA, 7195 bp, Artificial Sequence
  chemically treated genomic DNA (Homo sapiens)
aatgagtattttgttttatgatggaatgttttaaattgaaatatagatttttttagttataggaaatgatgataattttttattaatttttttagtttttttattttttaatgatcgttaaagaatatattttttcgaggaggagtttgagagttttgtttaaatttataaaaaattaagatagtttaattgtttattggagattttttttatgggaggtttgggtagaaggatagtgatttagatggaggtcggagatgagaaagaggagtaaagaaagtaataaaagtatgggtaaatatttttttaatgattataaaaagtagtaaaataatgatgtttattgagattaaaagatatatttaatatattagatagtaatagtatatttgttaaaagaagggttaatggtgttaaagtagtttaaggtttttgagttatttagaagataattattttgattaattttatattttagatattgtatgttttaatttatttaaaataataaaattaaagagtaaaatatttaaattagaggggaaaggtgaaataaaaaatatttagtaaattttatagaaggtaggaaaaggttttaaaaaggaatatttgaaatttaaattaagataggtttaaatttattatgaaggttatatgatagtggaggaaataaatagttaacgagttaagtgaatatatatgtaattttatatagtaatatatattatgtagaaaaatttaatagggtaaagtattagatgttgtttaggaggagattatttttaggtaagggaagatttaagatagaaagaggaggtaagtaagattttaagggtttttatcgtgagtaataataggttgagaagggaagaggagttaaggagattgaggagatagttagtgaaatgggaggaagtgttttaagaaggatggtatgattaattgtgaaattaagaatgtttggtttatttattataaatattttttttagatttggaaatatagttagtagtaaggttagtattaagttattataaggttaggtatagtggttgatgtttgtaattttagtatttgggtaggttaagaaaggcggattgtttgagtttaggagtttaagagattcgttatgggtaatatggtgaaattgtatttttataaaatgtacgaaaaattagttaggcgtggttgtacgtgtttgtagttttagttatttggaaggttggggtggaaggattatttgtattttagttttggtgatagagtaagattttgttttaatattaataattgtaaaagagttattatagatttaataggggatatataaatttatagcgtatagtggttaaacgtaagggttttgaggttagattatttgaattgtggtttaatttttttttagttgtgatttgtgtgattttgggtaagttatttaattattttgtgttttggtatttttatttgtaaaatggggataaagaatttgttttttttagttgttatgattaaacgagtttttttttttgagatagggttttattttgttgtttagattggaatgtagtggtatgataataattgtttgtagttttttaatttttgtgtttaagtgatttttttatttttgttttttgagtagttagggttatatgtgtttgttatttattatgtttggttaattttgtatatgttttgtagagatggggtttgtttacgttgtttaggttggtttcgaatttttgagttgaagtaatttttttattttgattttttaaagtgttgggattataggtgtgagttattgtatttagttaattttttttttttttttttttttgcgacgtcgttttgtttttgttgtttaggttggagtgtaatggcgtaattttagtttatcgtaattttcgtttttcgagtttaagcgatttttttgttttagtttttcgagtagttgggattatatgaatgtgttattatatgcggttaattttgtagttttagtagagacggggtttttttatgttggttaggttggtttcgaattttcgattttaggtgattcgttcgttttagttttttaaagtgttgggattataggtgtgagttattacgtttggtttcgagttaatattttttaaagtatttagaatatatttgatataaagtagtaataatgtgtatttttgttaaaatgagagagaaatttttaaaatggtaaagataggaaaaataattatgttttttaagtattgatttgtatttttagaaggtttaaattggtattagatttaggtaattgaattaattagtatgattgataggataattatagtttgataaagaaaatattatgaagggtagggtgcggtggtttacgtttgtaattttagtattttgggaggtcgaggtgggcggattatttgaggtcgggagttcgagattagtttgattaatatggagaaattttatttttattaaaaatataaaattagttaggcgtggtggcgtatgtttgtaattttagttatttggaaggttgaggaggagaattgtttgaatttgggaggaggttggggtgagtcgagatcgagttattgtattttagtaaggttttgttttaaaaaaaaaaataaaaattatgaagtaaattatggttgaaatatgtttagtttttaattgtagtattttgtatttaaggtgtatgtttataataagttatatttttattgttataaagaacgttttattaaatgtttattggtttagaattttattattttttgttagttagattatggtcgttttttttttagtttaaaataaatttagttgaaaagtaataataaatattttatgtatatagattaataataaaaaatagaaggtaatttgtttggtgttagatattgtaataagttaaataagtaatttttgtgtaaatattgaagtaagtgttttgaagaatttataaaagtttatgattttaatttatgtgagagataaaatgtatatatattagaagattatataatgaaagtatatggttaacgattaatgaatgatatagtaagtgttaaaagagataagatggggtagaggttattattgattgtaaaaagttttatgaatgaagcgagatttttatttgggtttaggaaaatgaagtcgttataattattatattttagtataagtaaggaattaaatagtatgttttttatgtgaatattttaagtaaataattggagaaagtattttaataaaataagggagtaaaataatgttggtttaaaatgaggtcgaaaagttgtagggttcggatcgtgttgttaaaggtataaatttgggagtttttaagttgtagttaatagttaacgtttagagaaggtagtgtatattttatagttttatgtaaaggaattttaattacgaagacgaattagttaaggagatcgaaaagggggggtttgtatggaaaggtatagtaacgaatgtaaaatttttttaataatattttaaaattgttttatagtttttttaattttgaaaatttaaaattatttaatttagttcgtagatttttgtgagaaataaggagatatttgtagtttagaaaaaattattaataattatttagaaagttattgttttattttttattgtaaattatattattacgattcgggatttttgttcgatttttagttaaggggtttttattgcgtttttgttgggttattttaaatttgtgataggatagtagcgttttttttgttttcggtcgaataaatattataacgtttgatattcggtgttgaaaggaaatcgggcgcggtgttttgtttatagtttggggagcggtttcgggcgtaataattgttatcggcgtcgagatgcggtttcggcgtttagggcgtcgttaaatttagagttcgggagttatggttgcgggcggtgtcgttttaggtaaattagtttaggagtagggttcgggtttggcgtatattttcggaaaaatgggggttagagtaaataagaagagcgaaagtaagagggttaggtagttagaggcggtagtaagatttaagacgttaacggcgtcgtttttttggggttttagggtttgcgttatttttgggttgtcggggtatcgtttttttacgtttttcgttcggcggcggttgcgattgttttcgaggttatgtttttaggacgggcgcgtttttagggtggaagtttggcgtacgttcggaggtgtcgaggatttaattagtttaaattttgggggaaatgatttttttttgttttcgtttcgcgttttgttattatttttttacgtttttgtttcgtttagcgatgtaaaacgcgcgaggcgtacggtagagggtcgaagtcgcggtatttttcgggttaggttcgtttttcggtcgcgtcgcgtagtacgggatttttcggtcgttgtttagcgttggtcgtttgagttaaggttgtcgcggagttagtatagtcggggtcgttggttggaagggcgagttttttaaggcggggggaagttcggcgtcggggtcgggtaggaaaggcgggggaggggtttcggtcgtttggaaggaatttacgcggtttgaggttgtgggggaagtagggtggcgagcggtttttttgcgcgcggggggcggggggggtggggtggtttattagggttttttggcgagggggcggttttttagtgtgtgagggcgacgttttagaagtttttttttaaagttggttttacgcgttgaatgtggaaagttgattgggatttagtagttttttattttaaatttgtttttcgagaagggttttaaatttaaaatgtgaatttcgtttttttttttagttagaattgtggattcgtttcggggaggggcggtgggtggggcggggttggcgggaaatttcggttttggcgcgttttttgcggcgacgtttatcgtgcgttttttttttttttcggtggttttttcgttcgttttttggttttgttatgttttgttttgaagagatattcgttattttatttagtaagcgggttcggtttgcggaggtgggcggtatgtagtttcgttttgttcggtttttcgagtacgttacggtttttattcggggtttcgcgcgcgtcgcgggttacgatttgtataggtgagcggggatttgtcggcgaggaggttgggaagggtcggtcgttcgttgttatagttagaaatagttatcggagagattataggaatatattagttataaataggatttttgtttttttcgtgtttaaaattttagtttttatttttggtataaattaaatagagatttgggtaaagattgtagaataagtaaaatagttatacggtgtttagtaaggcgttattttgtaacgtttattgtgttttttttaaatagaagatagagaggaaggtttatggtggttttcgagtggttcgagggtgatgttgtgtttaatagaaaaattaaggtgagagtttagatgtgagcgtgaaaatatttaagaaggatgaacgaagatgtatttgttttaaaaagttattttttatatatttattcggtttagggcggaatttgagaaggtatttgaaaacgaaaggtagagttgtttgtaatttattatatttttatttttatagtacgttttatttgtattaaaaatttttcgtatgttgttgtatttagtttttataataatttttaattagataagtgttattttttatataggtaggagtttgtgaagagttgaattgatttttttagaggtttgaagatgatataattttttatttcgaattttgggtttttttttttttatttgattattgtgtttagtttttagaattattaaggtaggagaaaagtaatgttgagagggaaggagattttatattaaattttaagtattgggatttattttaaagtattttagataatttaaatatgagaattattagtttaagtataggagaagagaaagtagtgtttgatgatagtaatagaaaaaaaaggaaaaggaaagtaggtatggataattgtagttggaaaaattatagttttttaattttgatgaataaaagtagagtgatatagtttgattagatttttttaaagtatattttggagtatttttttgagttttaggggagtttttgatttaagatattttaagtagatttttaataaatataggtgattttttgtatattgaaattgatatggaaataatggattagtaataaattagggtttaattgtttaaagagggattttagtgaaagaaggggtagtattgttttattagagttaattaaggtttttaaagtaaattttcggttttgtttattgtaaaattttttaaatttttatttaggagagggttatagtaatattaagagtagtagtatttgttatgtggattttagaggaattttgtttttaagtaaggtttatttttaggggtcgtttacggtgattagttgttttttttagttaggaaatttatagtttaagtttggtaaattattaagttttgtttgatagatataatatagttttttattttttattttgtttattcgttttttttttttttttttgtatattttttttaattatatagattattgtgagaataaaatgggttaatatatgtaaattaattagaattgtttttggtatatagtaaaggtttaattaatgatagttagtattattagtagtatttggttttttttttttgttttttttttattttttttttttttaaattatggttgtaaagtatttattttttgaaagtttgtttttttgtttttttacgttgataagtattttagtttttaataaatttttgtttaggggtaaatatttataatgttgatatttttttatattattaaaaatatttatggagaattattttatttaaagttgtttttttaataataaaatagttatttttattttttttataaatttttaagatgaattggtaatttattatagtaaggttgattttagaaattaaagttgtattaatttattaaatatattgaaagtaattttgtatgtttggttataaagaaaatataaaaataattttataaatagatttgtagttatttttttttaatatttttttagt

SEQ ID NO: 30 - DNA, 7195 bp, Artificial Sequence
  chemically treated genomic DNA (Homo sapiens)
attaagaaaatattgaaagaaaataattgtaaatttatttataaaattgtttttatattttttttgtgattaagtatataaaattatttttagtgtatttaatgaattaatgtaattttagtttttaaaattaattttgttatgatgaattattaatttattttaaaagtttatgaagaaggtagaggtggttattttattattaaaaagatagttttagataaaataattttttatgaatatttttggtggtgtgaagagatgttaatattgtaaatgtttgtttttgaataaaagtttattggaaattgaggtatttattagcgtgaaagggtagaaaggtaaatttttaaaaggtggatgttttataattatagtttgaaaaggaaaaaaatgaagaaagaataaagaaaaaaggttaaatattattaataatattagttattattgattaagtttttattgtgtgttaggaatagttttaattggtttatatatattaatttattttatttttataatgatttgtgtgattagggaaaatatgtagaaggaaaggagaaaaacgggtggataaaataagagataaagaattgtgttgtatttgttaggtagggtttggtagtttattaagtttaggttatgaattttttggttgagggagatagttgattatcgtgaacggtttttggagatggattttgtttaggaatagaatttttttaaagtttatatagtaaatgttgttatttttgatattattgtggtttttttttgggtagaaatttaagagattttataatgagtagaatcggaagtttattttggagattttaattaattttggtaaagtagtattatttttttttttattgaaatttttttttaaatagttaagttttaatttattgttgatttattatttttatgttaattttagtatatagaaagttatttgtgtttattaggagtttatttaaggtattttaaattaaggatttttttaggatttaagaaagtgttttaaaatatattttggaaaggtttagttaaattatattattttatttttatttattaaaattaagagattgtagtttttttagttataattgtttatatttattttttttttttttttttttttgttgttattattaggtattattttttttttttttgtgtttagattaatagtttttatgtttgaattatttgagatattttaaaataaattttaatgtttgggatttagtataaaattttttttttttttagtattattttttttttattttaatggttttaagaattgggtatagtagttagatgaaaaaaaaaaagtttaaaattcgggataaaaaattatattatttttaagtttttggggaaattaatttagttttttataaatttttgtttgtgtaaaaagtaatatttatttagttaaggattgttgtgaggattaaatataatagtatacggaaagtttttagtataggtaaaacgtgttgtagagatgaaagtgtggtagattataggtagttttgtttttcgtttttagatgtttttttaaatttcgttttgggtcggatgaatgtatagaaaataattttttaaggtagatgtattttcgtttattttttttaggtatttttacgtttatatttaggtttttattttggtttttttattgagtatagtattattttcgggttattcgaaagttattatgggtttttttttttattttttatttaggaagggtataataaacgttgtaaagtaacgttttgttagatatcgtatagttattttatttattttgtagtttttgtttaaatttttatttaatttatgttaaagatgaaagttaaaattttaaatacgaaaaaggtagaaattttatttatagttagtgtgtttttgtgattttttcggtgattgtttttagttgtggtagcggacggtcggttttttttagttttttcgtcggtaggttttcgtttatttgtataggtcgtagttcgcggcgcgcgcggagtttcgggtgggggtcgtggcgtgttcggagagtcgggtaaagcggagttgtatgtcgtttattttcgtaggtcgggttcgtttattgggtgaaatggcgggtgtttttttagagtagggtatggtagagttagaaggcgagcgaggagattatcgggggaagaggagagcgtacgatgagcgtcgtcgtagggagcgcgttaaaatcgaaatttttcgttagtttcgttttatttatcgttttttttcgggacgagtttatagttttggttgagaggggaggcgggatttatattttgggtttgaagtttttttcggaaagtaggtttgggatgggaaattattgggttttagttaattttttatatttagcgcgtggggttaattttgaaggggagtttttagggcgtcgtttttatatattagaaagtcgttttttcgttaggggattttaatggattattttatttttttcgtttttcgcgcgtagaaggatcgttcgttattttattttttttatagttttaagtcgcgtggattttttttagacggtcggagtttttttttcgttttttttattcggtttcggcgtcgggttttttttcgttttaggaagttcgtttttttagttagcggtttcgattgtattggtttcgcggtagttttggtttaggcggttagcgttggatagcggtcggggaatttcgtgttgcgcggcgcggtcgaggggcgggtttggttcggagagtatcgcggtttcggttttttgtcgtgcgtttcgcgcgttttgtatcgttgagcgaagtagagacgtaaggaaatggtagtagagcgcggggcgagggtagaggggagttattttttttagagtttgggttggttgggttttcggtattttcggacgtgcgttaggtttttattttgaagacgcgttcgttttgggaatatgatttcggaagtagtcgtagtcgtcgtcggacgaggggcgtggagaggcggtgtttcggtagtttagggatggcgtaggttttggggttttaggaagacggcgtcgttggcgttttgagttttgttgtcgtttttggttgtttagtttttttgttttcgttttttttgtttgttttggtttttattttttcgagagtgtacgttaggttcgggttttgtttttggattgatttatttggggcggtatcgttcgtagttatgattttcgggttttgagtttagcggcgttttaagcgtcggaatcgtatttcggcgtcggtgatagttattgcgttcggggtcgttttttaagttgtgggtaagatatcgcgttcgatttttttttagtatcgagtgttagacgttgtagtgtttattcgatcggaggtagggagggcgttattattttattataggtttgggataatttaatagaaacgtagtgggaattttttggttaggagtcgaataaggatttcgggtcgtggtagtatagtttatagtgggggataaagtagtaattttttagatagttgttaataattttttttgagttgtaagtatttttttattttttataaaaatttgcgagttgaattgaatggttttgaatttttaaaattaaaaaagttgtggggtagttttagagtattattggggaaattttatattcgttgttatgtttttttatataggtttttttttttcggtttttttaattggttcgttttcgtagttggaatttttttgtatgaggttatggaatatatattattttttttggacgttaattattagttatagtttgaggatttttaaatttatgtttttagtaatacgattcgagttttgtaatttttcgattttattttgagttaatattattttgtttttttattttgttgaagtattttttttagttatttatttaaaatgtttatatgagagatatattatttgattttttgtttgtattaagatgtaatgattgtaacgattttatttttttagatttagataaaagtttcgttttatttatgaaattttttataattagtagtgatttttgttttattttattttttttaatatttattatattatttattagtcgttagttatatatttttattgtgtaattttttgatgtatatgtattttattttttatatgaattagagttataaatttttatgaattttttaaagtatttattttagtgtttatataaaagttatttgtttggtttattataatatttaatattaagtaggttattttttattttttgttgttaatttgtatatataaagtgtttattgttattttttagttgagtttattttagattaaaagagaaacggttataatttaattggtaaaaagtaataggattttgagttagtaagtatttaatagaacgttttttatgataatagaaatataatttgttatgaatatatattttaaatgtaagatattgtagttaagaattaaatatgttttaattataatttattttatagtttttgtttttttttttgagatagagttttgttggagtgtaatggttcgatttcggtttattttaatttttttttaggtttaagtaatttttttttttagttttttaagtagttggaattataggtatgcgttattacgtttggttaattttgtatttttagtagagatggggtttttttatgttggttaggttggtttcgaattttcgattttaggtgattcgtttatttcggttttttaaagtgttgggattataggcgtgagttatcgtattttgttttttatggtgttttttttattagattatagttattttattagttatgttgattaatttaattatttaagtttagtgttaatttgaattttttgaaaatgtaagttagtatttgaaaagtatggttgttttttttatttttgttattttggggattttttttttattttaataaagatatatattgttattattttatgttaggtgtattttaagtgttttaaaaaatattaattcgaggttaggcgtggtggtttatatttataattttagtattttgggaggttgaggcgggcggattatttgaggtcgggagttcgagattagtttgattaatatggagaaatttcgtttttattaaaattataaaattagtcgtatgtgatggtatatttatgtaattttagttattcgggaggttgaggtaggagaatcgtttgaattcgggaggcggaagttgcggtgagttgagattgcgttattgtattttagtttgggtaataagagtaaaacgacgtcgtaaaaaaaaaaaaaaaaaaaaaattggttgggtgtagtggtttatatttgtaattttagtattttgggaggttaaggtgggaggattgttttagtttaggagttcgagattagtttgggtaacgtaggtagattttatttttataaaatatatataaaattagttaggtatggtgggtggtaggtatatgtagttttagttatttaggaggtagaggtgggaggattatttgagtataggagttgggaggttgtagatagttattattatgttattgtattttagtttgggtaatagagtgagattttgttttaaaaaaaaaaattcgtttaattatgataattagaggaaataaattttttatttttattttatagatgaggatattaaagtatagagtgattaaataatttatttaagattatatagattataattagaaggaggttaaattataatttagatagtttggttttagaatttttgcgtttagttattgtgcgttgtagatttatatgttttttgttgagtttatggtaatttttttgtagttgttgatgttgagataaggttttattttgttattaaggttggagtataggtggtttttttattttagttttttagatagttgggattataggtacgtgtaattacgtttggttaatttttcgtatattttgtagagatgtaattttattatgttgtttatggcgggttttttgaatttttgggtttaagtaattcgttttttttggtttgtttaagtgttaggattataggtattagttattgtgtttggttttgtggtaatttaatattgattttgttattggttgtgtttttaggtttgggagagatgtttgtagtaaataagttaagtatttttaattttatagttgattatattattttttttgaaatatttttttttattttattggttgtttttttagtttttttggttttttttttttttttaatttgttattgtttacgataaaaatttttggagttttatttattttttttttttattttaggtttttttttatttaaaaatagtttttttttaggtagtatttaatgttttattttgttgggtttttttgtatagtatatattgttatgtaaaattatatgtatatttatttgattcgttagttgtttgttttttttattattatataatttttatgatggatttaaatttattttaatttgggttttagatgtttttttttaaaatttttttttgttttttgtgaaatttattaaatgttttttattttattttttttttttaatttagatgttttattttttagttttattattttaaataaattaaaatatatagtgtttaaaatataaaattaattaaaatgattgttttttggataatttaaggattttagattgttttaatattattaattttttttttgataaatatgttattattgtttagtgtattaaatgtattttttaattttaataagtattattattttattattttttatagttattaaaaaaatatttatttatgtttttattattttttttgttttttttttttattttcgatttttatttggattattgtttttttgtttaaattttttatggagaggatttttaatagatagttgagttgttttagttttttgtgagtttgaataaaatttttaaattttttttcgggggaatatgttttttggcgattattgaggaatggaagaattgaaaaaattaatggaaaattgttattattttttataattgaaggaatttatattttaatttagaatattttattatggaataaaatatttatt

SEQ ID NO: 31 - DNA, 12465 bp, Artificial Sequence
  chemically treated genomic DNA (Homo sapiens)
attttttaggtaggttttatttttgtagaatttagaatttattgtttatattatattgatgttcgtttttttgtatttttttttttattagattgtgaatttttttagggtagaaattgggttttagttattttcgtatttttattgtttaatatagtgtttggtatagagtaggtttcgaggaaatgtttgttagtttgttagttggattttaattagaatattaatattttagttaattttttacggtaggtattatgtattggtttttaaagttgttattttgtgttaatatttatttgattttttttagttttattttatagaagaggagtttggggtttagagaagataggtgatttatttaaagttatatatataatagttagtagatttggttttaaatatttacggggttttttttagaatattatgttgtattttttttttatttatttatttagtaattttttgttttttaaattattaatatttttttttttattataatttatttattatattttaaaattatataaaaaggaatatagtttagtgaggcgtaagtgttttttttatttttgttttttagtttggttaagttttttaatatagttttgtagagatagtttaggtatatgtagtaattttgagatagggttttattgttgtttaggttggagtgtaatggtgtgatttcggtttattgtaatttgttttttttggatttaagtgatttttgtgttttagttttttaagtagttgggattataggtatgtataattacgtttagttaatttttgtatttttagtagagatagggttttattacgttggttaggttggtttttaatttttgattttgtgtgatttgtttattttagttttttaaagtgttgggattataggtgtaagttattgtattcggattttaaatattttttaggttttttttagttttatgttgtttgttttaagaattaggttatatggtttagagttgattggagaagggttagtcgttttttttagtttttttttttgtattgatttatttttttttttaagttttttttaggtttgtaggggtgggtgttttttttttttttttttttttttttgttttaggggtttatttgaattaggggaagggttattatgggtattgttatatatttttttttaggtgtaagagtgaggtggttttgattttgagtaatagtttttattatttatttatttttatgattcggtttcgtatattgaagaatcggttttgtcgttttttttttcgattttttttagtttcgatggttgttgtttttttggtatttgttgattgttttatgttatatatttggagtaaaagggaggtggaatggtttattagtgtcgattatcgtttttgattatacgttatttttatttttttttttttataatattttagtagttattgatttttattgattttattttttgatatatttcgtatttgtgttttttatttttgttgttattagtttaatttaggttttataatttggtgttaggtagtattttaggagttttattgggtttttttgttttaacgttattttttttgtattggatttttttgtattggttattagagtgatttttgggaagtaaatttgattatggtattttttagcgtaaagtttttgaaagtatttttaaagtaatggttttttagtgtttataaggtttaattttttttgttagatttataaggttttttatgatttgatttttgtttatttttttaagttttaaatatatttataatattttttttttattatattttatttagttttttttattttagtaagtggtattattatttattaagttgtttcggttaaaaatttaggagatattttttaatttttttttttttttattttttttttttttaaaataatttttatttaagttattattgttagttttttgaataattataattgtttttatgttggtattttagttttttttattgatttttatagtttaattatagaaattagaagtagtttttttttttgaaatatatgtttttttattttttttttttttttttttttttttttatttttattatttattttttggttaaatgaaaggttagaaagttaaatttgtttgtgtttttttatattttgggaagtttatttttggtatgtaatttagttaaagttgtagttaaaaaaattttagtaaatataaatttgattatgttttttatttgtttaaattttttattagttttttattatatttagaattagatttaaattttttattgtgggtttttaagatttagtttttgtatatttttttaatttgttttaaattattgttttttttgtttatagtgttttaggtaagttgattaagttttttaatatagtaattgtttttatttcggggtttttgtatgtgttgtttttttgtttggagcgtgattttttaattttttttatagttatttggatttttttggtgttttgttttgttttttattttgtaattgtgaagtagttgaatatatatgttcggttgatttttgtatttttagtagagatggggttttatagtgttagttaggatagttttaattttttgattttatgattcgttttttttggttttttaaagtgttgggattataggtatgagttattatatttggttttatttaattttttttaatatagatggggttttattatattgtttaagttagttttgaatttaagtaatttttttgtttcggttttttaaagtgttggtattataggtatgagttattgtgttcggcgttatttaggtttttaatttatttggagttgtattttgtgtatggtgtgagataaggatttaatttaattttttttttaagtgttattttattttttttaaatttaaaattttattttatttttggtcgggcgcggtggtttacgtttgtaattttagtattttgggaggtcgaggtaggtggattaggaggttaggagtttaagattagtttggttaatatagtgaaattttgtttttattaaaaatataaaaaaattagttaggcgtggtagtgggtatttgtaattttagttatttggaaggttgaggtagagaataaaatttattttatttttaatttgttttagatggggtttttttttgttgtttaggatggagtgtagtggtgtaattatggtttattgtagttttaaatttttgggtttaaaggatttttttgttttagttttttgagtagttgggattataggtgtgtgttattatgtttgtttaatttttaaaatttttttgtagagattgggttttgttatgttatttaggtttattattttattttttaaaagggaatagtatttttttatggattatatgagattgttgttttttagttattttatttttttagtttgattgttttttttagttgaattttatttatggtttttttattagattttatttattaagttttttttttttatttatttttgagatagggtattgttttgttatttaggttggagtgaagtggtgcggatattatttattatagttttaattttttaggtttaagtgatttttttgtttcggtattttgggtagattagaggtgagagttgttatatttagttaattttttaatttttagtagagatagggttttattatgttgtttaggttggttttgaattgttggttttaagtgatttttttgttttggtttgttttttttacgatgggattatagttgttagttattatgtttagttatttttttatttttttggatttgttttaagtttttaggattttttttagttttcggatataatttaataaatagttaaaggaataattatggtaattattagattttttttatgtttaagtttgagaatggtattaatttatttattggttttatttgttattatagtataaggttattgaaggggaagatttagttgatattttaagttttttggattgttaaggtttttgttttattaatgatagagagtagagagggaagagaggtaaggtggtattgtggtatagagttgtgggaatgggatgggggagaggtatggaggtagaggtaggtggaggtggagagcgttggtttagggattttgatttttgggggtttatataaaatattttttttagtaaggaatttcgattttgaagtttttaggttggttttgtatgtaattttgtttttgggttacggcggtagtttttgaattttgtttggtataataggagggaggtaggggataggggtagtattttaggtcgtagttttttttagtttgtatttttgttgtttgggagtagttttagttttatttataattcgttcgttttcgtaattcgtttcgttattaattttattttattattagtaaagtttgagtttatttaatattgaattttttcgttggtttttttttttcgtttagtttttcgtttttttcgggtttttttaattttcgattttgtttttgttttagttttgaaagttggttaggttaaagttatagtcgagtttttattttttttttgttttgaggggtataattttgttgtgatttttgttttagtaagcgtgagtttaggtttttttcgtttttttgaattttaagaattgttttgatttcgtttagtaataattttttcggggatttggttcgtaggagtaagtgtttgttgttgttatgtaataagaaaggggggcggaggtattacgttagtcgttagttcgtttttcgtatacgtaatattagttttcgtttttggttttatttttgtcggaaggcgaaaatttcgttaggtttggacgtattttcgcgatatttgtcggtcgttcggtttgtattgcggcgtttttcgcgcgggttattttagttttcgggcgtacggcgcggtttgttttattgtcgtcggcgtcgcggtcgttatggggtttttgaaattgattgagattgagaattttaagtcgtataagggtcgatagattatcggattattttagaggtttatcgttattattggatttaatggttttggtgagataaatttggtcgcggttttgcgtacgtttcggtttggattttttattcggtgtcggagtagtataatttagtttatgtaatttgaaacgtcgcggattttacgggttttttgttcgtttagagggggttttgttcgaatttatttttttcgcgcgggtgttttaattcgaattttttttaggtgttatttgtcgttttttgcgcggttttcgtttcggtttagtggtataggtcgagttgttagttatttcgtttatttttttttttcgttaaaggagtcgcgtttggaattagtttttcgttagtttagtttttcgtcgcgcggtttttcgtcggatcggtcggagtcggttttttagttttatttgatttttttcggagaatgtggggacgttggtagttttttcgtggttttcggttttaaacggtgtatttttgttttagtttagcgttttttttcgtttcgtattggtatattttaatttttttttatttttttttggaggcggtatttttgaattttagatttagcgttttagtttttagaatgtttgaggtgtcgatttttattttttatcgttatgttagaggtagttgtttcgaattcgttttttttttattatcgaaatcgttaaaagtcgaaattaattaatttattaaatttgttgaatgtttattgtttattaggagttatttagttgtaagttgtggaaatagcggagaatagaataaattaattttatgtttatagggaatttatattttagaggggaaagaagataaggagaaaataagatggttttaggttgttataagtgttatataggaaatgagataggtggatgtgataaagtgatttaggtggtgtttttagaaagggtggttaggtaaagtttttattttgtgtttttttaattttaaacgatatatcgtggattttttttattttagatgtttatttggaattttgttgtatttttttattttagagatgttttagttgaatgatattttagtttaagaggttgtttttgttgaagtagtatatattgagtattttttttggagattgagtgttttaatagtggtattattgatatttttagcgagataattttttgttgtgggatgtgttttgtgtattgtaggatgtttaatagtatttttggtatttatttgttagataatagtagtatttttgttttttaggtatgataattaaaattgtttttagatattgttagatgttatagagggtgtgtgtgatttttttaattttttaatttgtttgagaattattggtttggagggttaatgtttggtgtttatttagttttttcgggttttagtgtagtggtttttgttggaagagttaggatgtattttttggtatttagtttttttagtattagtagatttgtatttttagttgttttgaaaagggttatggtatttttttatttgttttcgttttttaaggtttatttttataagttatttttttagtttttttggtgagtgagtttttttttgtggtatatcgtagatatttggtatacgttaatgtttattaagttttatattgatggtgtatgtttttgtatttttattggtttgtgagtattttaaagtagatattttttgaaacgttttattggtgtttagtttataatatatattataaaaatgtttattatattgattgtgattagagaggtttggggttgtgagatgatgttgttttttttggaaatgatgggagaagtttaaaggttggatattggtttttaaaaggttgatttttggtttgtatgatgtgttagttttgttgtgatgagggagatagttgagtttagatttaggataggattaattaattgagtatttattttgtgtgttaagtattttatttattgggattttgtttttttttttttttttttttttttttttttttttttttgagatagttttgttttgttgtttaggttggagtgtagtggtatgatgttggtttattgtaatttttgttttttgggtttaagtgattttcgtgttttagttttttaagtagttgggattataggcgtgcgttattttatttggttagtttttgtatttttagtagagttggtgttttttttagttggttaggttggttttaaatttttgggtttaagtgatttgtttgttttagttttttaaagtgttgggattataggtatgagttattgtatttagttaagggattttttataattaaatttttaaaatgattttaggaggaaaatgttaatagtttcgttttatatatgaggagattaaggtatagaggtgtgataatttgttcgtggtttttagaatttatgtttgtgtttttgttattttaatagagaagtatgtgtcgtatatatttttagattcgtgagttgtggttttttttatttttttttaggtgagggaatggaaggttagttaagtggtagtgaaagtaagattagaatttggtttgttggttttaagtttaagtttgtaagtttttttagatggagttttattttgacgtttatattggagtgtagtggtatgatttcggtttattgtaatttttgtttgttgggtttaagtgatttttttttttttttttttttttttttttttgagatgaagtttttttttgtcgtttaggttggagtgtagtggcgtgattttagtttattgtaatttttgtttttcgggtttaagttatttttttgttttagttttttgaggagttgggattataggcgtgtattattatgttcggttagtttttgtatttttagtagagacggggttttattacgttgtttaggttggttttaaatttttgatttcgtgatttgtttatttgggttttttaaagtgttgcgattataggtgtgagttatcgcgtttggtttattttttttttttttggagttagggttttgttttgttattaaggttggtatatagtggtataattatggtttattgtagttttaatttttcgggtttaagtaatttttttattttagtttttttagtagttaggataattggagtgtgttattatgtcgagttaatttttgtattttttgtagagatgggattttgttatgttgtttaggttggttttaaattttcgaggttaagtgatttatttacgtttgttttttagagtgttgggattataggcgtgagatgtcgtgtttaatttaattatagttttatatcgtttttatggaaggatttgggttgttgtttttatggttgagtagaaaggtgttggaaattagatttttagtttaaagttatatataagttttttagggatagttttgagatagaaattatagagattaaattgtttttttttatttattagttcgattaaatttttttttttttttttttttttttgagatagagtttttttttgtcgtttaggttggagtgtagtggcgcgattttagtttattgtaatttttattttttgggtttaagcgattttcgtgttttagtttttcgagtagttgggattataggtatataatcgtgtttggttaatttttgtatttttagtagggacggggttttattatgttggttaggttggttttaaatttttgattttaggtgattcgtttgtttcggttttttaaagtgttgggattatagttatgagttattgtattcggtttaaatttttaaaataatatttattttttggttaggaacggtggtttatgtttgtaattttagtattttgggagtttaaggtggaggatttttggagtttaggagtttgagattagtttaggtaatatagggagattttgtttttgtaaaaatttaaaaattagttgggtatggtggtttatgtttatgtttttcgttatttgtgaggttgagatacgaggattatttgagttaaggaggttagcgttgtagagagttgtgatattgttattgtattttagtttgggttatagagttagattttgttttagtatgtaaatgaataaggtttgggagtggtagtttatgtttgtaattttagtattttaggagatcgaggtgtgtggattatttgaggttaggaattcgagattagtttggtttatatgatgaaattttaattttattaaaaatataaaaattaattaggtgtggtggtatacgtttgtcgttttagttatttaggagattgaggtaggagaattatttgaatttggtaggtgtaatttagcgtgggcgatagagcgagattttattttaaaaaataaataaaataagtaaatgaaattttttttgttttcggattttaaaatgaataaagtaaaagttgtaattttattattgaaaagatagttattgttaatgttgaaaattttatttatttgaatagttggtatatgtatatggtatataattttaaaaatttttaaggatatatagtagtaaaaagaagatttttttgattttagttgtttagttttttttttagaggtaattattgttgtattgtttacgtttttatatatttgttttttatgttttttttttttttaagttttattatgaaaatttgtaagtatatatgtgtattatttagttatttggaagtaaattatagatttaattatattttatttttaagtgttttagtatttattttttaaaattattatttttttgtattattattatttagttattataattaagaaaatttttttatgttattaattatttagtttatatttaagtttttttaatttgttttttaaatgtttttttgttattttggaattagagtttagttaaagtttgtgtattgtttatttatgttttagaaattttttatgttttggaatggttcgtttattttttttttttttttttttttgagatggagttttgtttttgttgtttaggttggagtgtaatggcgtgattttggtttatcgtaatttttgttttttaggtttaagcgagttttttgttttagttttttgagtagttgggattataggtatgtgttattatgtttagttaattttgtatttttagtagagacgaggtttttttatgttagttaggttggtttggaattttttaattttaggtgattcgttcgtttcggttatttaaagtgttgggataataggcgtgagttatcgtgttcggtttattttttttttttagatattgattttttgaaaagattaggttatttgtttttgagaatattttatattttgtgtttgtgttaagatttttttatgaaaattttattatgtttttttatattgtattgttgtattttttaggaattggaagataagtttgaaggtttgtttagatttagattaggttggatatggtggtttatgtttgtaattttagtattttgggaggttacggcgggaggattatttgaggttaggagtttaagattagtttgggtaatatagcgagattttgtttttattataataaaaaattaaaaaaaggaaaaaaatagatttaggttaaatatttttggtaagatatattataaatgatgttgtgtgttttatattgttttataataggaatatgtattttttttagatggtggtaaaatatatataaaattttttaaattaattatttttaagtgtgtagtttagtagtgttaaatatatttacgtttttgtgtaaacgatttttagaatttttttattttgtaaaaatgaaaatttatgtttattaaaaaataatttttaggttaggcgtggtggtttatgtttgtaattttagtattttgggaggtcgaggtgggcgaattataaggttagaagatcgagattattttggttaatatggtgaaattttgtttttattaaaaatatagaaagttagttgggtgtggtgatgtgtgtttgtaattttagttattcgggaggttgaggtgggagaattttttgaattagggagtcggaggttgtggtgagttgagattacgttattgtattttagtttggtaatagagtaagattttattttaaaagaaaaaaaaattttttatttttttttttttttagtttatttttaaattttattttatattattattattattattattttattttattttattttttttttttgagatggagttttattttgttgtttaggttggagtgtagtggtacgattttggtttattgtagtttttattttttaggtttaagcgatttttttgttttagttttttaagtagttgggattataggcgttcgttattacgtttagttaagttttgtattttttagtagagatagggttttattatattggttaggttggttttgaatttttgattttaggtgatttatttgttttagttttttaaagtgttgggattataggcgtgagttattatgttcggtttattttatattattttaatatcgttgagttttgtgttttgtttgttttatttattgtgggtttttgtttatgttattaaaggttgtaaaattatttattttgtgaatatattatttttttagattgggttttagtttttttttttaaattattttttttttttttttttttttttttattattttttttaaagagagttttgttttgttatttaggttggagtgtagtggtgttattatagtttatgtagttttgaatttttgagtttaagcgattttttttttttagttttttgagtagttgagattataggcgtatgttattatgtttagttaattttttttttttttttttgagatggagtttcgttttgtcgtttaggttagagtgtagtggtacgatttcggtttattgtaattttcgttttttaggtttaaggaatttttttgttttagtttttcgagtagtttatgtttagttaatttttaaagtttttgtagagattgggttttgttttgttgtttaagttggttttaaatttttggttttaagcgatttttttgtttcggtattttaaagtgttgggattataggtgtgagttattacgtttattttgggttttagtttttggttgttatatagtaattgtaaaaggattgttttttttaagtttttgatttagaggtttggttgtgtttagtttttatggggatagaggagtagtttttttttttattagtttgagtattgagtgattaggggatatttttgtttattttaatatttttattttttttttttttttttttattttgattttttttttattgtttcgtttttttttttttagg

SEQ ID NO: 32 - DNA, 12465 bp, Artificial Sequence
  chemically treated genomic DNA (Homo sapiens)
tttaagggaagagggacgaggtagtagagggaaagttaggatgaagaggagaggaaaaggaataaagatattgagatgaataaaaatgttttttaattatttagtatttagattaatgggaagagagattatttttttgtttttataaagattgagtataattaaatttttgggttaaaggtttaggaaaaatagtttttttgtagttattatatagtagttagaagttagaatttaggataagcgtagtgatttatatttgtaattttagtattttgggatgtcgaggtaggaagatcgtttgaggttaggagtttgaaattagtttggataataaggtaaaatttagtttttataaaaattttaaaaattagttgggtatgagttattcgggaggttgaggtaggagaattttttgaatttgggaggcggaggttgtagtgagtcgagatcgtgttattgtattttagtttgggcgatagagcgagattttattttaaaaaaaaaaaaaaaaaattagttgggtatagtggtatgcgtttgtagttttagttatttagaaggttgaggagggaggatcgtttgagtttaagagtttaaagttgtatgagttatgatgatattattgtattttagtttgggtgatagaataagattttttttaaaaaaaatagtgaaaaaaaaaaaaaaagaggaaagaatagtttaaaaaaagaagttagaatttaatttaaagaaatggtatatttatagaatggatagttttataatttttaatgatatggataaaagtttataataggtgaaataaataagatataaaatttaacgatgttaaaataatataaagtgggtcgggtatggtggtttacgtttgtaattttagtattttgggaggttgaggtaggtggattatttgaggttaggagtttaagattagtttgattaatatggtgaaattttgtttttattaaaaaatataaaatttagttgggcgtggtggcgggcgtttgtaattttagttatttggaaggttgaggtaggagaatcgtttgaatttgggaggtggaggttgtagtgagttaagatcgtgttattgtattttagtttgggtaatagagtaagattttattttaaaaaaaaaaaataaaataaaataaaataataataataataataatgtaaagtaaaatttaaaaataggttgggaggaggggaaaatgggaggttttttttttttttgagatggagttttgttttgttgttaggttggagtgtagtggcgtgattttagtttattataattttcgattttttggtttaagggatttttttattttagtttttcgaatagttgggattataggtatatattattatatttagttaattttttgtatttttagtagagatagggttttattatgttggttaggatggtttcgattttttgattttgtgattcgtttatttcggttttttaaagtgttgggattataggtatgagttattacgtttggtttgggagttgttttttaatgggtatagatttttatttttgtaagatgaaaaagttttagagatcgtttgtataaaaacgtgaatatatttaatattattgaattgtatatttaaaaatggttaatttaggaaattttatgtgtattttattattatttaaaaaaagtgtatatttttgttgtgaaataatatgaaatatatagtattatttatgatgtattttattaaaaatatttaatttgaatttattttttttttttttttaattttttgttataataaagataaggtttcgttgtgttgtttaggttagttttgaatttttggttttaagtgattttttcgtcgtggttttttaaagtgttgggattataggtatgagttattatatttagtttaatttgaatttaaataagtttttagatttattttttagtttttaggaaatatagtaatataatatagaggaatatagtaaggtttttatgaggaaattttaatataaatatagaatgtgggatgtttttaaagataaatggtttggtttttttaaaaagttagtgtttaaaaagaaagggtgagtcgggtacggtggtttacgtttgttattttagtattttgggtggtcgaggcgggcggattatttgaggttggggagttttagattagtttgattaatatggagaaatttcgtttttattaaaaatataaaattagttgggtatggtggtatatgtttgtaattttagttatttaggaggttgaggtaggagattcgtttgaatttgggaggtaaaggttgcggtgagttaagattacgttattgtattttagtttgggtaataagagtaaaattttattttaaaaaaaaaaaaaaaaaaaaagtgagcgaattattttaaaatatgagagatttttgagatataggtaaatagtgtataaattttgattggattttggttttaaaataataaaaagatatttggggagtaagttaaggaagtttaaatataaattggataattgatgatatgaggaaatttttttagttgtgataattgaatagtggtagtataggagaatgatgattttaagaggtgaatgttgaagtatttaggggtgaaatgtaattgagtttgtaatttatttttaaatgattaagtaatgtatatatatgtttgtaaatttttataataaaatttgggagaagagaaggtataggaaataaatatatgaaaacgtaaatagtgtagtagtgattgtttttgaaaaggaaattaagtagttagggttaagggagttttttttttattattgtatatttttaaggatttttaaaattgtatattatgtatatgtattagttatttaaataaataaggtttttaatattaatagtggttatttttttagtagtggagttatagtttttattttgtttattttagaattcgaaaataaaaaaggttttatttatttattttatttattttttgagatggagtttcgttttatcgtttacgttagattgtatttattaagtttaagtgatttttttgttttagttttttgaatagttgggacgataagcgtgtgttattatatttagttaatttttgtatttttagtagagttggggttttattatgtgagttaggttggtttcgaatttttgattttaagtgatttatatatttcggttttttaaagtgttgggattataggtataagttattatttttagattttatttatttatatattgagatagagtttgattttgtaatttaggttggagtgtagtagtagtattatagttttttgtagcgttgatttttttggtttaagtgattttcgtgttttagttttataagtagcgggaagtatgggtataagttattatgtttagttagtttttggatttttgtagaagtagggtttttttatgttgtttaggttggttttaaatttttgagttttagagattttttattttggatttttaaagtgttggggttataggtatgagttatcgtttttggttaaaaaatagatattgttttaaaagtttaggtcgggtgtagtggtttatgattgtaattttagtattttgaaaggtcgaggtaggcggattatttgaggttaggagtttgagattagtttggttaatatggtgaaatttcgtttttattaaaaatataaaaattagttaggtacggttgtgtgtttataattttagttattcgggaggttgaggtacgagaatcgtttaaatttaggaggtggaggttatagtgagttgagatcgcgttattgtattttaatttgggcgatagagagagattttgttttaaaaaaaaaaaaaaaaaaaaaaaagtttagtcgggttggtggataaggaggaatagtttagtttttataatttttattttaagattgtttttaaagaatttatatatgattttgaattgaagatttgatttttaatatttttttatttagttataaaaatagtagtttaagtttttttatagagacggtataagattatgattaggttggatacggtattttacgtttgtaattttagtattttgggaagtagacgtgggtggattatttgatttcgggagtttgagattagtttggataatatggtaaaattttatttttataaaaaatataaaaattggttcggtatggtggtatattttagttgttttgattattgggaaggttgagatgggagggttgtttgagttcgagaagttgaggttgtagtgagttatgattgtgttattgtatgttagttttggtgatagagtaagattttgattttaaaaaaaaaaaaaataggttaggcgcggtggtttatatttgtaatcgtagtattttgggaggtttaggtgggtagattacggggttaggagtttgagattagtttgaataacgtggtgaaatttcgtttttattaaaaatataaaaattggtcgggtatagtggtgtacgtttgtaattttagttttttaggaggttgaggtaggagaatagtttgaattcgggaggtagaggttgtagtgagttgagattacgttattgtattttagtttgggcgatagagaaagattttattttaaaaaaaaaaaaaagaaaaaaaagaaaagaattatttgaatttagtaggtagaagttgtagtgagtcgaggttatgttattgtattttagtgtgggcgttagagtgagattttatttaaaaaagtttgtaaatttgggtttagaattaatagattaggttttaattttatttttattattatttagttgattttttatttttttatttggaaaaagatgaaaaaaattataatttacgggtttaaaaatatgtgcggtatatatttttttattggagtggtaggagtataggtatgggttttgagaattacggataagttattatatttttgtgttttagtttttttatgtataaaacgaagttattggtattttttttttagggttattttgagaatttaattgtaaagggttttttggttgggtgtagtggtttatgtttgtaattttagtattttgggaggttgaggtaggtagattatttgagtttaggagtttgagattagtttggttaattgggagaaatattaattttattaaaaatataagaattagttagatggggtggcgtacgtttgtagttttagttatttgggaggttgaggtacgagaattatttgaatttaagaggtagaggttgtagtgagttaatattatgttattgtattttagtttggataatagagtaagattgttttaaaaaaaaaaaaaaagaaaagaaaaagaaaaagaaaaaatagggttttaataaataaagtatttgatatatagagtaggtatttaattaattagttttattttaagtttggatttagttgttttttttattatagtaggattagtatattatgtagattaggagttagttttttaggaattaatatttaatttttgggttttttttattatttttagggaggataatattattttataattttaagtttttttaattataattaatatggtaaatatttttgtaatatatattatggattgaatattagtaaaacgttttaaggaatgtttgttttagggtatttataggttaatgaagatataaaaatatgtattattaatataggatttaataaatattaacgtgtattaagtgtttacggtatgttatagaggaagatttatttattaaagggattaaaggaatggtttgtagaggtgggttttgaagaacgggggtaagtgggggagtgttatagttttttttagaatagttgggaatataaatttattaatgttgaggggattgaatgttaagaggtatattttagtttttttaataggggttattatattaaaattcgaggaaattgggtggatattaagtattagttttttaggttagtggtttttaaataagttggggggttgggggaattatatatattttttgtgatatttagtaatgtttagagatagttttgattgttatgtttggggagtaggggtgttattgttatttagtaggtagatgttagagatgttgttaaatattttataatgtatagagtatattttatagtaaaggattatttcgttggaaatgttaatagtgttattgttgagatatttagtttttaggaaaggtatttagtatgtgttattttagtaagggtagttttttaggttaggatattatttagttagaatatttttggggtggaagaatatagtaggattttaaatggatatttgaggtgagaggaatttacggtgtatcgtttagagttgggaagatataaaatagaggttttatttgattattttttttaaagatattatttaagttattttattatatttatttgttttattttttgtatagtatttatgatagtttaaaattattttattttttttttatttttttttttttttggaatataagttttttgtgagtatggagttggtttattttatttttcgttgtttttataatttgtaattgaataatttttgataaataataagtatttaataaatttggtaaattagttaatttcggtttttgacggtttcggtggtaggaaaagggcgagttcgaggtaattatttttgatatagcggtggggggtggggatcgatattttaagtattttaaagattggagcgttgggtttgaaatttaaaagtgtcgtttttagagaagagtagaaaggagttggagtgtattaatgcgaggcgagagaggacgttgggttgaaatagaagtgtatcgtttgggatcgaaggttacgggagagttattagcgtttttatatttttcggagggggttaagtaaggttgggaagtcggtttcggtcggttcggcggggagtcgcgcggcggaggattgagttggcgggaagttggttttagacgcgatttttttggcgggagggggaagtaggcggggtaattggtagttcggtttgtattattgggtcggggcgggggtcgcgtaggaagcggtaagtgatatttggaaggggttcgagttagagtattcgcgcggggagagtgggttcgagtagaattttttttggacgggtaaggaattcgtaaggttcgcgacgttttaggttatatgggttgggttgtattatttcggtatcggataaggggtttaggtcgggacgtgcgtagggtcgcggttaggtttattttattagagttattgggtttaatgatggcggtgaatttttgaaatggttcgataatttgtcgatttttgtacgatttaaagtttttaattttaattagttttaggaattttatgacggtcgcggcgtcggcggtagtaggataggtcgcgtcgtacgttcgagaattgaggtagttcgcgcgggaaacgtcgtagtgtaagtcgggcgatcggtaaatgtcgcgagaatacgtttaggtttaacgggattttcgtttttcggtaggagtgggattaggggcggggattgatgttgcgtatacgaggagcgagttgacgattggcgtggtgttttcgttttttttttttgttgtatggtaataataaatatttgtttttgcggattagattttcggaggagttgttgttgggcggagttagagtagtttttgaggtttaaggaggcgggggagatttgagtttacgtttgttgagatagaagttatagtaggattatgttttttagggtaagaggaaggtgggagttcggttgtggttttagtttggttagtttttaaggttaggataaggatagggtcgggaattggaaggattcggggggagcggagagttggacgggaaggaggggttaacgggaggatttagtgttaggtgagtttagattttgttaatggtggggtgggattggtggcgggacgggttgcgaaggcggacgggttgtgaatgggattggggttatttttaggtaatagggatataggttggggaaggttacggtttgagatattatttttattttttgttttttttttgttgtattaagtagagtttagaaattgtcgtcgtaatttaagaataaagttgtatgtagagttaatttaagagttttaaaatcgggattttttattgagaaaggtattttgtgtgaatttttaggagttagggtttttaagttagcgttttttatttttatttatttttgtttttatgttttttttttattttatttttatagttttatattataatgttattttattttttttttttttttgttttttattattaataaggtaggggttttagtaatttaagaagtttaaaatgttagttgaatttttttttttagtgattttatattgtaatggtaggtgaaattagtaggtaagttggtgttatttttagatttaaatatggaaaggatttggtggttgttataattatttttttaattatttattaaattatgttcgaaggttagaaagagttttaaagatttaggataagtttaggaaagtgaggaagtggttgggtatggtggttgataattgtaattttatcgtgagggaggtaggttaaggtaggaggattatttgagattagtagtttaagattagtttgggtaatatagtgagattttatttttattaaaaattaaaaaattagttgggtgtggtagtttttatttttggtttatttaggatgtcgaagtaggaggattatttgagtttgggaggttgaggttgtagtgagtggtgttcgtattattttattttagtttaggtgatagagtaatattttgttttaaaaataaataaagggaggaagtttggtagatggaatttagtaggggagttataaatgaagtttagttgggagaaataattaggttgaggggataaaatggttaaaagatagtaattttatgtaatttatggggaaatattgtttttttttaaaagatgagatggtgagtttgggtaatatagtaaaatttaatttttataaaaaaattttaaaaattaggtaggtatggtggtatatatttgtagttttagttatttaggaggttggggtaggaagattttttgagtttaggagtttgaggttgtagtgagttatgattgtattattatattttattttgggtaatagagagagattttatttaaaataaattaaaaataaaataaattttattttttgttttagttttttaagtagttaggattataggtgtttattgttacgtttggttaatttttttgtatttttagtaaagatagggttttattatgttggttaggttggttttgaatttttgattttttgatttatttgtttcggttttttaaagtgttgggattataggcgtgagttatcgcgttcggttaaaaataaaataaaattttaaatttaaaaaagatgagatggtatttggggggaaaattaaattggatttttattttatattatatataaaatgtaattttaagtggattaaaaatttaagtgacgtcgggtataatggtttatgtttgtaatattagtattttgggaggtcgaggtaggagaattgtttgagtttaagattagtttgggtaatatagtgagattttatttatattaaaaaaaattaaatggggttaggtgtggtggtttatgtttgtaattttagtattttgggaggttaaggagggcggattataaggttaggagattgagattattttggttaatattgtgaaattttatttttattaaaaatataaaaattagtcgggtatatatgtttaattattttatagttataaaatggaaaataaaataaaatattaaaaagatttaaatagttataggaggaattaaagaattacgttttaaataaaggaatagtatatataaaggtttcggggtgggaataattattgtgttggaggatttgattagtttgtttggagtattgtaagtaagggagatagtggtttgagataaattggagaggtgtgtaggaattagattttgaaagtttatagtaaggagtttggatttgattttaagtatagtgggaagttagtggaggatttaagtaggtgagagatatgattagatttatgtttgttaaagtttttttggttgtagttttggttgggttatatgttaaaagtgagttttttaaaatatgaaggaatataggtaaatttagttttttagttttttatttgattagaaaataagtaataaaagtaaaaaaaaaaaaaaaaaaaaaaaaagggtggggggatatatattttagaaaagaaagttgtttttggtttttgtgattgggttataggagttaatagaggaagttggaatattaatatggagatagttgtggttatttaggaagttggtaatggtggtttggataagggttattttgaaagaagaaggagtgagggaaaggaaggattaaaggatgttttttaggtttttgatcggagtaatttggtgaatggtggtgttatttattgaaataaggaaaattgaatagagtataatgaaaaaggagtgttgtagatgtgtttgaggtttagaaaggtgagtaggggttagattatgaagaattttataaatttggtaaagggggttgggttttataagtattggggagttattgttttaaaggtgtttttaaaggttttacgttgaggagtgttatggttagatttgttttttaaagattattttggtagttagtgtagagaaatttagtgtagagagggtaacgttggagtaagagaatttagtggggtttttgagatattgtttgatattagattgtgaggtttgaattaagttggtgatagtagagatggagggtatagatacgaaatatattaggaagtaaaattagtaggaattaataattgttgaaatattatagggagaaaggaatgggggtggcgtgtagttaaagacggtggtcggtattgatgggttattttattttttttttgttttagatgtataatataaaatagttaatagatattaaggaagtagtagttatcgaggttagaagaaatcgagaaaaagagcgataaaatcgattttttaatgtgcggaatcgagttatgggggtgagtgggtagtagggattgttgtttaggattagggttattttatttttatatttggagaggaatgtgtaatagtgtttatgatagttttttttttgatttaagtaggtttttagggtaggaaaggaaagagagggagagaaggtatttatttttataggtttgggaagagtttgggaagagggataggttagtgtaggggaagagattaggggagacggttgatttttttttagttagttttgggttatgtgatttggtttttgagataggtaatatggagttaaaagaggtttaaagaatatttggagttcgggtgtagtggtttatatttgtaattttagtattttaggaggttgaggtgagtagattatataaggttaggagttaaagattagtttggttaacgtggtgaaattttgtttttattgaaaatataaaaattagttgggcgtggttgtgtatgtttataattttagttatttgggaggttgaagtataagaattatttgaatttaggaggagtaggttatagtgagtcgagattatattattgtattttagtttgagtaatagtgagattttgttttaaaattattgtatatatttaaattatttttgtaaggttatgttgagaaatttaattaggttgagagatagagatggaagggatatttacgttttattaaattgtatttttttttgtatgattttgaaatgtgataaatgaattataataaaagagaaaatattgatagtttaagaaataaaagattgttaggtgagtggatagaggggggatgtagtatggtattttggaaaagatttcgtaagtatttaaggttaggtttgttgattgttatgtgtgtggttttggataaattatttgttttttttgagttttaggttttttttttgtaaaatgaggttgaaggaagttaggtgagtgttaatatagagtggtagttttgaaaattagtgtatagtgtttgtcgtaagaagttggttagggtattagtgttttgattgagatttagttgataagttgataagtattttttcggggtttgttttgtgttaagtattgtgttgggtagtggggatacgaaaatgattaaggtttagtttttgttttgaaagggtttatagtttggtggaggagagaatatagagaggcgaatattaatataatgtagatagtgggttttagattttataggagtagaatttgtttgaggggt

SEQ ID NO: 33 - DNA, 11735 bp, Artificial Sequence
  chemically treated genomic DNA (Homo sapiens)
atttattttttaataatgttttagtaaaaaggttattattagtagaatttttttaaagtaatattttgtttttttttttaaaaaataatttttttttttttaattattaaagtaatatatgtttattgtagaataggaaaagtataaagaagatggagtagggattttttttttttgttttttatagttttgatttggtttttttgtgatttgggattcgtgtgaataggtgatgtgttgaggagttcgggatagggaatatgtatttttaggaagtgtttgttaagtagtttgtattttgattaataggattttgagtatagggaatttgtggaattttttaggagaagatatattagttggaatggaagtttgttttagtttggggatttttttaggattatttggggttgtttggaataggaatttttttatttatttgttttgtggttttaggtaagttatggtttttttatttggaaaatagtattaagtatttttaatttatttagttgtgggatatagtttttttatttttagtaatgtgtgtagtattggaatttttggtttattagtagaatgtatttttttttatatggggttttggggttgagtttattgtttataatagcgtagtgttttgggagagatttgagtttagattttgattttatttttaaatagttgttaagtttttttatatattttagttttaatttttttatttgtttaaaatgtatttgtgttatagggtagttgggaggtttcgataaaataatgtatgtaaaatatttagttgggtgtttacgtttaggaagtttttaggaaatgtgaattattattatttattttaggtttattttgtgtttggtattttaggggaggaaggcgtaaaagtgaaaataaagtttgggttttgtttttaaggagtttgaagatttgttgataggtagattaaagtaaaagggttttatgtattggagataggattagagacgtaagaaaattgttaatttttgaggttttttataaattaggttttatgttgaaagttttatatgtattatttatgagatttttttataattttatgaggtaagtgttattaggattagaaaattaaggattaaagattagagaatttaggaaattttgtttgggttatatagttaataaagtgttagggtttgggtttgaattttgggatgtttgattttagattttttgttttttttattttatttgagttggattttgaaggatgagttagatttgggtatatggggatggaggggaggaggggtttggaggggaggcggggtttgaagaataggaggatatggagttaggtaagtaaagtttgggagatgggaaagtgtagggcgtgtacggtagaaattttgagggttttgtgtgtgtgtgtgtgtgtgtgtgtgtgtgtgtatgtgtgtgtgtgtgtttgagatagggtttcgttttgtgatttaggttggagtgtagtggtacgattttggtttattgtaatttttattttttgggtttaagcgatttttttgttttagtttttcgagtagttgggattataagtatatattattacgtttggttaattttttttttttttgtatttttagtagagataggtttttgttatgttgattatgttgattttaagtttttggttttaagtgatttatttatttcggttttttaaagtgttgggattataggtatgagttatcgtgttcggtttgtttgtttattttgagatagttttattgtgttatttaggttggagtgtagtgatatgattatggtttattgtagttttgatttttttgggtttaggtgatttttttattttagtttttcgagtagttgggattataggcgtgtgttattacgtttagttaatttttttgtattttggagagatagagttttgttatgttgtttaggttggttttaaatttttgggtttaatagatttgtttattttggttttttaaagtgttgggtttataggtatgaattaatgtgttcggtttgaaattgtaagtatttagtttggttttatgtgagggttttttcgggtttattttatataaattttagttaaaatatattaagtatttattatgtatttgatatttttttaaggattttataattaatattttattaaggttttatagtaaatggagaggttatttgtgtcgtttttattttaaagatgaggaaattgagatttagaatggtttagtaatttgattatgattataatgttaggaatgaatggggtaggaatttaagtttagggaggtagattttagatttgtgttttatatttattgtaagaattagttagtttttaggtagtgaaattttaaagttagttttagttgttcgaaatttaattatagagagttggtttttagttttttattggtttttttttttttttttagttttattttgttatttttatttttttttttggttttggggttttgttgtttttttaaatttgttttgttataattttttttaggtttttttatttgtaaaatggggataataatagtgttcgttttagagtagtgttgtgaggattagaggaggggtttaaggtgtttagagtttagtgtatagtaggtttttaataaaaattagtgattatcgttattattgttatttaagtagtgtttttgaagtaatgtgaaattgattgagtgatagtattatttatatttgatggttgaggaaattgtggttaagagaagtgaagtagcggttgtttagtgttatttaattaggaagtagagagcgggatttatttaatttgggttttttgattttttgattttagattttattaattttttttattttttgtagttaggtagatgagtgaattataattagtatttattatttgttttttgtattttaagttaggttttagatgttaaggggtattttagagagatttgatttagatttttgaaggagtatagaatttaattgataaataaggtatgaaaacgaagttttgttttgttgaggtagaatatattaagggttttaagagggtaagagttattttggttgagaggaagtaggtaggggaggttttttggaggaggtgagatttaagttggtttttaaaggattaaaaaggattaatgagatacgtagattagagtaaaagggttttatgtattggagataaggttagagatgtgatcgggagcggtgatttatatttgtaattttagtattttgggaggttaagtagggcggattgtttgaggttaggagttcgagattagcgtggttaatatggtgaaattttgtttttattgaaaatataaaaattagttaggtatggtggttggcgtttgtaattttagttattcgggaggttgaggtaggagatttatttgaatttgaggtaggagaattgtatcgttgtattttaatttggtgatagagtgagattttgtttaaaaaaaaaaagttagagatataataatagttgttaatttttgaggttttttatgatttaggttttgtgatgaaagttttatatgtattattttatgagatttttttatgattatatgaggtaagtgttattaggaggagaaaattaaggattaaggattagagaatttataaaatttgttttggttatataatgaataataaagtgtttgggtttgggtttgaattcggggttgttggttataaagtttgggtttttaattattatgggttattgttattttggttttaattatttaatgaggaattaagttgtggattgtttttggagggttttgaatgttaaggtttagatttgtataaaaattatatagtattaggtaagaaattagatttgaaatttagtagtagtttttagtaattttttattatttattatttaagtttgtttttttgagtttttttaaatcggagtgatgaggaatgtattattagtaatgaaggtttttgaatgaggtagagaggtttttgtgataaaaggattgtttaaaagaaatttagagatgtttaaatatttattgagtattgggttttaataatataattgtgaataagataaagttttgtagtgggattttgattttgttgtgtttttaggtagtttgggagagtagaagaattttttaattggaaaaataagggttttagagttgggatttgttttagattttgttgttagtttttaaattagggaatttttttgtatgattttgggtaagttatttagttttttagattgttagtttttattatggggattattatttttttttttaggattgttggaataaattaattaaaataacgtttgtaaggatttagtatggtgtttggtattttgtaggcgttgaatagatgttagttttttttataaagaagtagattagtttgttttcgttttttatttttttgttattaaagggaataggtttttggtttttattttagtaggaaaggggatatgaatgtatatgtgttagttaagtaataatgtaaattaataaaagggtttgtggtttggggaatatattgttgggtttgggtttaggttgggatttcgcgttaaaatgtttttttttaattttagggaattcgggtttatttttcggggcgttgtgtattgttttggtcgtttttgtattgtgaatttcggaattattttttgttttcgtttcgtcggttgttaattagcgcggtcggcggttggcggtattaatagtaggtgtggttgtttttttaagtagcgaagttagtgttgtaatcgtcgtttcgaggacgcgtttttttcgggggggggggggggggtggagtttgtattgtcgtagtagttaatcggagcgcggtatttttcgcgggagattcgaatttcgcggtacgacgtttggcgttaaaaaaaaaaaaaaaagaagaaaaaaaagaggtagagaaagatttaaggattagagagcgagtcgtaaggaagtcggtgtagtcgagatttttttttttattttagcgtatcgcgttttcgtcgagtttgagggtacgtcggggatttttttttagagtcggtcggattttaggtgtcgaggttttggggagcgcggggcgtttcgggtcgcggtgttttcgggacgagatagtttttggtagtgttattatcgtagtcgtcgggcgatttttaagcggcgatttttaagcgttgttttttgttcggtcgcgggttaggaggggagggttcggttttgtttcgtaggcgtttattggcggtttttttcggttttcgcgttatgtcgcgggtcgtgtgaaaggcggtagtatcggaattcgtaggtgttcgcgggcgcgttaagtttttttgggtagggggcgttttattcgttatgttgtaagggtttcgggttttggtttcggtcgttgggtagatttcgaaggtggtgttcgcgatgagttttatagagttgtggttattcggttttagtagtttttagttttgtttagttattgttatttattatatatcgttgtattcgtagacggcgtttttcgtagcggcgttaggtatttgtttcgacgttattttttacggattcgagggttaagttgtgcgatgtttgtcggtaggtcggttgtcggtaatgttgggggtttttatcgtttttttttatgtttttttaggtgtgggaaaggagggaggggtgtttgagatttagtttgagtggagtaggtagagttttgggaagagggaagatgagtttttagtttttaggatttagtgtttttaatatttgagtagaagatttttttatttttagattttggatgaaataattttatttattttagtggagtggaatgagtattggattgcgagtttggagggagatttaatttattatttttagtgtattgtgtgattttggggaagtttatgtagttagcgttgtcgttatttatttattattttattgtttggttagaaattagtattgggtgtttgttattgtttaggtaaagagtatggtttggggatattgtgggattttggtaagatagagggataggtttagtgggttttttatatttaatttgttatggatagattttaaattgtttagttagtttttgagatagttttaagtatttgttttaggtttttttttaggtttagtttttttttttagatagttatgtagtagatataaatgtgggtagtttttttgggttttgtttagattggttgttttttttttaagtttttaggttcgttgttagagagggtttaaagtgtagtggtattaggttgtttgttgatttgggtttagggtgtgttttgtgggagtggaatttttggagttcgtgtgaattaaaataattttagggtggggggtggagtgggaaaagtttgggggagtggaggtggtggtggttgaggagtttggtttttggtgtgattttgttattaattttttgtgtgtttttggataagttttggatttagtttgggttttagtgtttttttttttataatgcgtgtgtgtatagggtggttgtggggttagttttttttagttatatttagttttaggttttgggttttggaagtaggttttagggagaggaagggggtgttgtaggtttgtttagttgtgagtttggtgaataagttcgggtatagggataagattattttttattgttttagaggtatttggttagatttgtgttagttagtaagtacggatgtttagttagttttggatgtaggtagagttattattttttgttagtggatttaggttttgtttatgtttaaaacgttaatttttttggagattttttttgtatatgatttttaattaggagggtagtgggtaggaatggtattatttttattttataggttaagtaatcgaggataattgggattgggtattttgtgtttagtgttttatagtttaaaatatttttgtagttcgtgaaatagatggtattaatagttttatgttatagggggaaattgaggtttagagaggggatgtgatttaaggttagagatggggatggggtagagtgatgggatttataaggtagttagtttttttgttttttattttttattttttgtagagataggggtttttttatgttttttaggttggttttaaatttttgggtttaagtaatttttttgttttagttttttaaagtgttgggattataggtatgagttagttattttaatgtatttggttaggtagtaggtttttttttatgtagttttgattttttttaatattgtttaatttaggagttgagttttttttagggaagggagttttgcggtaggtttatttttttttggttagttgtttttagattggaagttttagtaatagttgtggttttatattgttttgaatttttttagaggagtttaagtatatttgtttgtattttttttttagaagggtttagtgattttagtaagaaggttttttttttattgagtgtttttcgtgtgttagatattgtttggtattttttacgtttattattttggttaggatgtttagaatgaggtattttgtagataaggaaattgagtaaagaaaggaagttatttgtttgggttataagtgaagaagtaggggagtttttttgtagtagattattttaaagttttgttaggtttagagttttcgtttttgttaatttttagatgttcggggtttagtttcgtgggtaggtttgttttttgtttatttattttataagggcgtgatttggaatagttttaaatttaattttgggtgtggtcgtttgttttgtggtcgggttgtaaagtgtagggtgagtaggatttgttgtggagtttttgtttaaagggattttaggtattgtttaaggatggtaattaagtttaatggtagaatgaaggttataatttagattttttggttttttgtttagagttttttttaagttttttgaggaaggtttagggaatgtttttttatcgtatgttttttttggttaggcgtatggtattatttttttttacgtttgtaggaagttttgtttaggttggtttgtaatagcgttatttttgtttattgtaaattttattttttaggtttaaatgatttttttgttttagttttttaagtagttgggattattttttgtatttttagtagagatggggttttattatgttggttaggttagtttcgaatttttgattttaggtgatttattcgttttggttttttaaagtgttgggattataagcgtgagttattacgttcggtttttttttttttttaatttgtttatattttttagatttttttttgtgaggtatgaaagaaaataaatattttaatatataattttataaggtaggttaggtgaggaggtgtaggtttagagaggtaagatagtgaattttaggttgtttagttacgaagtggtagagttgggatttgaaagtaaggttcgattttttatatttgtttttatttttattatttgatttagggtttaggagagattaggttttattttgcgtgattttgggtaagttaattttttttttttaagttttagtttttttatcgtggtgttcgtaagggggttgtgtttggtgatttttgattttttgtatttttgtagttgtttgaggaaggagttgtatttttttttataggggttggtagggtgggtttgcgttttgattaggttttgaagatttagttaaaggggttgtttaagagcgtttaggatagggttaagttggtttttggttgtggttatagtttttgtttttttttttttatcgtagtttttttttagtttatttttgaatttttttttttttttattggtgttttttatatattagtgttagtagttttttggtgggggtattttttatgggtaaagcgttttgttgtattattttattgaatttttagtataggtggagataatgatgtttattttataggtgatttgacgttaattgattttttagttaagaaggggaaggtttagatgtaaagttaggttagtttgattttaagatttgtgtttagttttattttgatgttgatttttttgggtttgttttttgttatttgtgttttgtaggtttagtttaagttataggttgatttttttttgggtattgtttaaaggtgttagggaggtatttttagggggatatttgtcgtattgggattttgggagtgtagaataagggtgaaggagagtgagaaaagagagaaggttgtgtgtgtgtgtgtgtgtgtgtgtgtgtgtaagtatatgtagtgatgggggtaggtgggcgtagtttaggttttggtttaaattttagtaaattttggggtagcgtgtgtgggatgtagttgaggtagtttggtatatggttttgtagttagataggtttgggtttaaattttggtttcggtttttgtgtgattttgggtatgtgtttattttttgtaagtttttattttttggttttcgagagttagtgttaatattgatgtggtaggattgttacgagtatgtaataggtttagtatagatattttgtttaaggtttttttgggattttttttggtttgttttggcgggggagataggtgtggttggggaggttttgggttgttttatttttgttttaggtagaattttatttgagtttttttttttttttttgtttttggtgtttttgttgggggatatatgaagaatattaggatgtgtagttttggttaggattgatggaggtttcggagttttttaagttttaattattttagttgtataatggggattagtggtatgggaagatttagtgaagtgatgaatgttggggcgtggtttagggtatgtggaaggttttagttagtgattggttttttttttagtgatagtatggggttaaatttttagaatataggattttattagttaggaaggtagaaaaggaatatttaagagatttatttaagaatgagtagtaaagtgtttggatggtttttaggtttcggtagtggtggaaagtaagagtgttatatttaggttttttaaattaaggagtagggttttttatattagtttaggaagattttttggagggggtaggagtgggggaaggggaattgatagtaggaagagttgttattatttttaatatttgttagtttagttgtgtttagtagtagttagaagttttagttttgttgagtatgattttattattaaatgttaaaataggtttttttgtttaagttagggtaggggtgtttgggggatttagagttggaaagaggaaagaaatgggttcgatgatttttagaaggatgtatgaaggaagaggtcgagattagattttagggaagggattttgtgttttttgaatatttattgtgtgttgagatataggttgagaattttatagaagttaaaggagtaggagttaattagggttttttttttatatgtagatagggagttaaataagtgttttaaagggaagttacgcggggattaatttagtttgttttagggtttttaagatgtagaggttgtttaggtagtgttttttttgaatttttataatagttttttgaggtaggtatttttattttatttatagaggaagaaattgaggttttttagatgtgtaatattttttttaatttgtatcgtgagtttgcgaaggagttggagatttaagtatgggtttttgatttatgttttagtgttttagtgttttagttttgtttttgttttgtttttgtttagttttaattaggagagaggtttttttcgggttagtgtagttttgggtttaattggggttcgggtggtaatagggtggagaggagtagatgggtttgtggtttgatttttttagtaggtgttttttaagtttggcgggaatagaaagggggagttggagggggggggtggttttagttgtttgtttttaagatacgggaaggatttattgtttgtttttttcggtaaagaaagaatggtaaatgtagtttatttaggaggttttggggtttttaagttggagtttaaatatgggggtggggatgtttgtattgttttttattgtgggtatttttttgggttgtggtattgagttaggaagttttttgggtttgggcggatgtttagtttcgttttgataaggattagttgtgggattgtgatgggtatttagtttagttgggttagttgtttttgtaggggggttttttttttattttgatgtggtttaggttttatttattgtttttttttggtattattttttgggtgtggtggggtgaggagtaggtataggagtcggtttagggttcgtggttaaggagttttgagtttttggttagattggttttggtagggttttaagtgtttgggttttagaggatgggagttttatttgttttttagaaaataagattttttttgaaagtttattttttaggttattgatgtttttttattaagtatagtagtgttttattaggattggcggtaaattgaggtatagaggtggttgttaagtggttttattgttttggttttatattagggaaaggttaaaggaggaatgatttttaaattttgttttttttttttttttttttttaagg

SEQ ID NO: 34 - DNA, 11735 bp, Artificial Sequence
  chemically treated genomic DNA (Homo sapiens)
ttttggagaaaagggggagagagaggtagagtttgagaattattttttttttagtttttttttgatgtggggttaaagtaatgaagttatttagtagttatttttgtgttttagtttatcgttagttttggtgaagtattgttgtatttgataggaaaatattagtgatttgagaagtgagtttttaggggaaattttgttttttgaagggtaaataaaatttttattttttgaggtttaggtatttgagattttattaaagttagtttggttaagggtttagagttttttaattacgggttttaagtcggtttttatatttgttttttattttattatatttagaggatgatattaggaggaagtagtgggtggggtttaaattatattagggtggggaaagggtttttttatagaagtagttggtttagttagattgagtgtttattatagttttatagttggtttttattagggcggggttgggtattcgtttagatttaggggattttttggtttagtgttataatttagggaggtgtttatagtgggaagtagtgtaaatatttttatttttatgtttgggttttagtttgagggttttagggttttttgaatagattgtatttgttattttttttttgtcgagaggggtagataatgaatttttttcgtgttttaaggataagtagttgaggttattttttttttttagttttttttttttgttttcgttaagtttgggaaatatttgttggggaaattaaattatagatttatttgtttttttttattttgttgttattcgggttttaattaggtttagagttgtattggttcggaaagggttttttttttggttagggttgggtaggggtagggtaggggtagagttggggtattgggatattgggatataggttagagatttatgtttgaatttttagttttttcgtaggtttacggtataagttgggggaaatgttatatatttaaggagttttagtttttttttttgtaaatggggtaaaaatgtttattttaaggggttattgtaaggatttaaggaaggtattatttgggtagtttttgtattttaaaaattttggaataggttgaattaattttcgcgtggtttttttttgaagtatttatttagttttttgtttgtatgtgggagaaagattttggttagtttttgtttttttaatttttgtaaagtttttagtttgtgttttagtatatagtaggtgtttaggaaatatagagttttttttttaaaatttaatttcgatttttttttttatatatttttttgggggttatcgagtttattttttttttttttttaattttggattttttagatatttttattttggtttggatagagaggtttattttaatatttagtggtgaggttatgtttagtagggttgagatttttaattgttgttgagtatagttgggttgataggtgttggaggtggtgatagttttttttgttgttagtttttttttttttatttttgttttttttaggaagtttttttgggttgatgtgaggagttttgttttttggtttgaggagtttggatataatatttttgttttttattattatcgagatttggaaattatttaaatattttattgtttatttttgaatgagttttttgaatattttttttttatttttttaattggtgaaattttatattttagagatttagttttatgttgttattagagaaagggttagttattggttgagattttttatatgttttgaattacgttttaatatttattattttattgaatttttttatattattaatttttattgtatagttgaagtaattgaggtttggggagtttcgaggtttttattaattttgattaaggttgtatattttagtattttttatatattttttagtaggagtattaagggtagggagaggaagggaagtttaggtggagttttatttgaggtagaggtggggtagtttagagtttttttagttatatttgtttttttcgttagaataaattagaaagaattttaggaagattttgaatagaatatttatgttgagtttgttatatgttcgtaatagttttattatattagtattggtattggttttcggaagttaaaaaatggagatttatagagagtaagtatatgtttaaggttatataaaggtcggagttagggtttgaatttaggtttgtttgattgtaaagttatgtattaggttgttttagttgtattttatatacgttgttttaggatttgttagaatttgggttaaggtttgggttacgtttatttgtttttattattgtatgtatttgtatatatatatatatatatatatatatatagttttttttttttttttatttttttttatttttattttgtatttttagggttttaatgcggtaagtgtttttttaaggatatttttttgatatttttggatagtgtttagaggaaagttagtttatggtttgggttgaatttgtagaatataggtggtagaggataagtttaggaggattagtattaaggtgaggttgagtataggttttggagttagattggtttggttttgtatttaggtttttttttttttagttgggaaattagttgacgttaagttatttataaaatgggtattattgtttttatttatgttgaggatttagtgagatagtgtagtaaagcgttttgtttatagggagtgtttttattagggagttgttagtattgatgtatggggagtattagtgggaaaaggggaaagtttaagggtgagttgaaaagagattgcgatgaggggaggagagtaaaggttatggttatagttagaggttagtttagttttattttggacgtttttaggtagtttttttggttggatttttaaggtttggttaggacgtaagtttattttgttaatttttatggagaagagtatagttttttttttaggtagttgtagaagtgtagagggttagagattattaggtataatttttttacgggtattacggtgaggaaattgggatttggggaagaggaattgatttgtttaaggttacgtagagtggagtttggttttttttaagttttaagttagatggtgggggtaggagtaaatgtaaggggtcgaattttgtttttagattttagttttgttatttcgtagttgaatagtttgggatttattgttttgtttttttgagtttatatttttttatttgatttgttttgtagagttgtgtgttaaaatgtttatttttttttatgttttataagaggaaatttggaaaatgtagataaattgaaagaaaaggaggatcgggcgtggtggtttacgtttgtaattttagtattttgggaggttaaggcgggtggattatttgaggttaggagttcgaagttagtttggttaatatggtgaaattttatttttattaaaaatataaaaagtaattttagttatttgggaggttgagataggagaattatttgaatttgggaggtggagtttgtagtgagtagagatggcgttattgtaagttagtttgggtagagttttttgtaggcgtgaaagagaatgatgttatgcgtttggttagaggaggtatgcgataaaggggtattttttgagttttttttagaggatttggaaagagttttggatagggagttaggagatttgggttgtggtttttattttgttattgaatttggttgttatttttggatagtgtttgaggtttttttaaatagaagttttataataaattttgtttattttgtattttgtagttcggttataaagtaagcggttatatttagggttgggtttggaattgttttaggttacgtttttgtaaaatgagtaagtagagggtaggtttgtttacggggttgggtttcgggtatttggggattgataggagcgggagttttgggtttggtagggttttagggtggtttgttgtaaggagatttttttgtttttttatttgtgatttaggtaagtgattttttttttttgtttagtttttttatttgtaaggtgttttattttggatattttgattaagataatgaacgtgaagagtgttaagtagtgtttggtatacgagaggtatttagtaaaagagagatttttttgttaagattattgagtttttttgggagggaggtatagatagatgtatttgggtttttttgggagggtttaaagtagtgtaaaattatagttgttattgaaatttttagtttgaaagtagttggttagaggagagtgggtttgtcgtaaagtttttttttttggggggagtttagtttttaagttaggtagtattaaaaaaagttaaggttatatagagaagagtttgttgtttgattaggtgtattagagtagttagtttatgtttgtaattttagtattttgggaggttgaggtaagaggattgtttgagtttaggagtttgagattagtttggggaatatagggagatttttgtttttataaaaaataaaaaataaaagatagaagagttgattgttttgtgagttttattattttattttatttttatttttgattttaggttatattttttttttgagttttagtttttttttgtaatatggagttattaatgttatttattttacgaattataaagatgttttaggttataaaatattgaatataagatatttaattttagttattttcggttgtttaatttgtaaaatggggataatattatttttgtttattgtttttttagttagaaattatgtgtaggaagggtttttaggaaggttaacgttttgaatatgggtaaagtttgagtttattggtagggagtggtggttttgtttgtatttagagttggttgggtattcgtgtttgttgattagtataggtttgattagatgtttttggggtagtggggggtggttttatttttgtattcgaatttatttattaaatttataattaagtaaatttataatattttttttttttttttggagtttgtttttaaaatttaggatttggagttgaatgtggttgagaagagttagttttatagttattttgtgtatatacgtattgtgaaggagagaatattgaagtttagattgggtttaagatttgtttaaggatatatagagaattagtggtagagttatattagaaattaggttttttaattattattatttttatttttttaggttttttttattttattttttattttaaagttgttttgatttatacgggttttaggaattttatttttataaaatatattttgagtttaggttagtaggtagtttggtgttattatattttgggttttttttggtaacgagtttgggagtttgaggagagagtagttaatttgaatagaatttaagggggttgtttatatttgtatttgttatatggttgtttgggagggaagattgggtttgggggaggatttagggtagatatttggggttattttaggagttggttggataatttggagtttgtttatggtagattggatgtgagagatttattagatttatttttttgttttattaaagttttatagtgtttttaggttatattttttgtttggataatagtaggtatttagtattggtttttggttaaataatgaagtaatgaatgaatggcggtaacgttggttgtatggatttttttaaggttatatagtgtattgggagtagtgagttgggtttttttttagattcgtaatttagtgtttattttattttattagaatggatgagattattttatttaaagtttgaaaatgaaggggttttttatttagatattgggggtattgggttttggaaattgaaagtttattttttttttttttaaaattttatttgttttatttaaattggattttaggtatttttttttttttttttatatttggaaaagtatagggggaagcggtgggggtttttagtattatcggtagtcggtttgtcggtaggtatcgtataatttggttttcgggttcgtggggagtggcgtcgaggtaggtgtttggcgtcgttgcgggaggcgtcgtttgcgggtatagcggtgtgtagtaggtagtagtagttgggtagagttgggggttgttgaggtcggatggttatagttttgtggggtttatcgcgggtattattttcggggtttgtttagcggtcgaagttaaggttcggggtttttgtagtatagcgagtaaggcgttttttatttaaaagggtttggcgcgttcgcggatatttgcgggtttcggtgttgtcgttttttatacggttcgcggtatggcgcggaggtcgggggaagtcgttaatggacgtttgcggggtaaggtcggattttttttttttggttcgcggtcgagtagagagtagcgtttagagatcgtcgtttggagatcgttcggcggttgcggtggtggtattgttaggggttgtttcgtttcgagggtatcgcgattcgggacgtttcgcgttttttaaggtttcggtatttggggttcggtcggttttggggaggggttttcggcgtgtttttaagttcggcggagacgcgatgcgttgggatggggaggggggtttcgattgtatcgatttttttgcggttcgttttttagtttttgagtttttttttgttttttttttttttttttttttttttttttttagcgttaaacgtcgtgtcgcgaaattcggatttttcgcggaaaatgtcgcgtttcggttggttgttgcgatagtataggttttattttttttttttttttcggaaagaacgcgttttcgaggcggcgattgtaatattagtttcgttgtttaaaggggtagttatatttgttgttggtgtcgttagtcgtcggtcgcgttagttagtagtcggcgagacggagatagagggtggtttcgggatttatagtgtagaggcggttagagtagtgtatagcgtttcgagaaatgggttcggattttttgggattgaagggaaatattttggcgcggggttttagtttgagtttagatttagtagtgtattttttaggttataggtttttttgttagtttgtattgttgtttagttagtatatgtgtatttatatttttttttttgttaaaatgaaggttaggaatttgttttttttaatggtagaggggtgagggacggaggtaaattagtttatttttttgtagggaaaattaatatttatttagcgtttataggatgttaggtattatgttagatttttataagcgttgttttagttaatttattttaataattttgggaagaggaatgatgatttttatgataaagattgatagtttgaaaggttgggtaatttgtttaaggttatatagagagattttttgatttgagagttggtaatagaatttgggataggttttagttttggagtttttgtttttttagttaaggggtttttttatttttttaagttgtttgggggtatagtagggttagagttttattgtagagttttgttttgtttatagttgtattattaggatttaatatttagtaaatgtttgaatatttttaggttttttttaaataatttttttgttataagagtttttttgttttatttaaaaatttttattgttgataatatattttttattatttcggtttagagaggtttagagaagtaaatttgggtagtgagtggtaaaaagttgttagaagttgttgttagattttaggtttgattttttgtttggtgttgtgtgatttttatgtaagtttgagttttggtatttaaagttttttagagatagtttatagtttaattttttattagatggttgaggttaaggtggtaataatttatgatgattaagagtttaggttttgtagttaatagtttcgaatttaaatttaggtttagatattttattatttattgtgtgattaaggtaaattttgtaaattttttgatttttgatttttgattttttttttttaatagtatttattttatatgattatgaggaaattttatgagataatgtatataaagtttttattatagaatttggattataaggagttttaagaattggtagttgttgttatatttttgattttttttttttagatagagttttattttgttattaggttggagtgtagcggtgtaatttttttgttttaggtttaagtgagttttttgttttagtttttcgagtagttgggattataggcgttagttattatgtttggttaatttttgtatttttagtagaggtagggttttattatgttggttacgttggtttcggatttttgattttaggtaattcgttttatttggttttttaaagtgttgggattataggtgtgagttatcgttttcggttatatttttgattttatttttagtgtataagatttttttattttagtttacgtattttattggttttttttggttttttgagggttagtttaaattttattttttttaagaagttttttttgtttgtttttttttagttagaatggtttttatttttttgggatttttagtgtgttttattttaataaaataaggtttcgtttttatattttgtttattagttaggttttatgtttttttaagaatttaggttagatttttttagaatgttttttagtatttagggtttggtttggagtgtagaaggtaggtaataaatattgattatgatttatttatttgtttggttgtaaagaataggagaagttaatgagatttgaagttagaaagttaggaggtttagattaagtaagtttcgttttttattttttagttaagtgatattggatagtcgttgttttattttttttaattataatttttttaattattaaatgtggataatgttattatttagttaattttatattattttagagatattatttaaatgatagtggtggcgatgattattgatttttattgagaatttattatatattgggttttaagtattttgagttttttttttgatttttataatattgttttgagacggatattattattatttttattttatagatgagggaatttggaaggaattgtggtagagtaggtttggggaagtagtagggttttagggttagggagggaaatgggggtggtagggtggagttgggagaaaagaagggagttagtgaggggttgagagttagttttttgtggttgagtttcgggtagttggggttggttttagagttttattgtttgggaattgattaatttttgtaataggtgtggggtatagatttgaaatttgtttttttgagtttgaatttttgttttatttatttttagtattgtgattatggttaggttgttggattattttgagttttaatttttttatttttgaaatggaggcggtataagtgatttttttatttattgtgaggttttagtaaggtgttggttataaagtttttagagaaatgttaggtgtatggtaggtatttaatatattttggttaaggtttatgtgaaatggattcgaagaggtttttatatggaattagattaaatatttgtagttttaggtcgggtatattggtttatgtttgtgaatttagtattttgggaggttaaggtggatagatttgttgagtttaggagtttgagattagtttgggtaatatggtaaaattttgtttttttaaaatatagaaaaattagttgggcgtggtggtatacgtttgtaattttagttgttcgggaggttgaggtgggaggattatttgagtttagggaggttaaggttgtagtgagttatgattatgttattgtattttagtttgggtgatatagtaagattgttttaaaataaataaataggtcgggtacggtggtttatgtttgtaattttagtattttgggaggtcgaggtgggtggattatttgagattaggagtttgagattagtatggttaatatggtaaaaatttgtttttattaaaaatataaaaaaaaaaaaaattagttaggcgtggtggtgtgtgtttgtaattttagttattcgggaggttgaggtaggagaatcgtttgaatttaggaggtggaggttgtaatgagttaagatcgtgttattgtattttagtttgggttatagagcgagattttgttttaaatatatatatatatatatatatatatatatatatatatatatatatataaaatttttagagtttttgtcgtatacgttttatatttttttattttttaggttttgtttatttggttttatatttttttattttttaggtttcgttttttttttaggtttttttttttttttatttttatgtgtttaaatttgatttattttttaaggtttaatttaaatggagtggaaggagtaaagaatttgaagttagatattttagggtttaaatttaggttttgatattttattagttgtgtgatttaggtaaaattttttaaattttttgatttttgatttttgattttttaattttaatagtatttattttataggattgtgaagaaattttatagataatgtatataaagtttttagtatggaatttggtttataaggagttttaagaattggtagtttttttacgtttttgattttatttttagtgtataagatttttttattttaatttatttattaataaatttttagattttttgggggtaggatttaggttttgtttttatttttgcgttttttttttttgagatgttaggtataaagtaggtttgaaataaatgataatagtttatattttttgagaattttttaggcgtaaatatttagttaggtattttatatatattattttgtcgaaattttttaattattttgtaatataggtatattttggatagatgaagaaattgaagttgaaatatgtaaaggaatttgataattgtttgaagatgaaattaggatttgaatttagattttttttaaggtattgcgttgttgtgaatagtgaatttagttttaaaattttatgtgaaggagggtatattttgttaatgaattaggggttttagtgttgtatatattgttggaagtggaaagattgtgttttataattggatgagttggggatgtttagtattattttttagatgaggaagttatgatttgtttgaggttatagagtaggtaagtgaggaagtttttgttttaggtaattttagatagttttggaaaaatttttaaattaaagtaaatttttattttagttggtgtatttttttttgaaaaattttatagattttttgtgtttaaagttttgttaattagaatataaattgtttgatagatattttttgaaggtatatattttttgtttcgggttttttagtatattatttgtttatacgaattttaaattatagagaaattagattagagttatgggaaataagggagaaaaatttttgttttattttttttgtgttttttttattttataataaatatgtattattttggtgattggagaaaaaaaagttgttttttaaaaagagaaataaggtattgttttaaggaagttttgttagtggtaatttttttattggaatattgttggaagatgggt

SEQ ID NO: 35 - DNA, 12405 bp, Artificial Sequence
  chemically treated genomic DNA (Homo sapiens)
  unsure (7895)
tttttttaaaagtttatataaagtttatttaaaaatttttttttaaaaatttaaagtttatgtattttaaaaatattaaatatagtagtagttagtttggagtgataagacgatttatgtagattttttaaggagagatttttttgtggtagagtagtgattgggaattgaaatatgcggtttttggagggagcgttttgcgtttttaaagtaagttatttatttttttatatttaatttttttattgatttggtagtttttatagatttattgaaaatatatagtggttatttttaggaattattttttgtttgtttttattttaagtaattttttatttttttattttttataatattttgtttattttaggtattattttattttttaaattttattttataaagtgttggttataattttagagttttagatatgtatgtaattttttgttattgtttattattttttaataataagtggaaattaagatttttttgtttttttaggttattttatatatttgatatgaaattttttgtagattattgttatttgaattgtttttttaatgtagttatataatttggaaatttttggttgtgtattaaatttatttaaagttatttgaaattatataagtttatttaaaaatgttttattataaatgtatttatgaatatgtagttaatgttaaattttattttgattatttattagttttgtggatttgtttttagtataatagggagaatattaaagttgttatgagtattaaattagataatgtttttgtaagattttattatataattattttgttattggtttataaaaggttttttttaattgtggattgaaataaaatattttgtattaatatttaaagatataaattatttttaatagtgtttaaaattaagtaataattagtttaaattttattatgaaatagattaatataaagtattatgtggtttagttgaaagtaagtttttttagtttttattttaatttttattaaaataagtttattgtattttaaggtggggtaataaaagtaaaattttattttaaaaaaaaaaaaaaaaagttagtttgttattattaataaataagtaaaattttgttggatttttttaaatatttaattattagattatgataaaattgtgtatattttaaattgattttgaatttttataaaaatggtatttgtgaaattttataaatgttagatattataagtttaatgagttgtggattaagaaattattttgttttgaaatatttaagtttttttttttagttttgaattagttaaggagttgtatttttaaaatgtatttaaaaaaagaaaatttaattaggggtatataaataatattataattgaaaatagtatttatttaattaattagcgtaaattgaatttaatgaaggattattgttatgtatttattatttttataggttaatgaaatatagtttagtttaattggatttttttttttttttttttttttaggatagatttttattttgttatttaggttggattgtagtggtaggatgataggttattatatttttgattttttgggtttaagtgatttttttattttagtttttttagtggttgggattataagtgtgtattattacgtttagttaatttttgtagtttttgtagaaatggggttttgttatgttgtttaggttggttttgagtttttgggtttaggtaattttttttttttagttttttaaagtgttaggattatagataggcgtgagtgtttagttaggcgtgagtatttagttagttttgatttttgttggaaataatttttaagtttttgttagaaatggtataaagaattgatgtaggaatttatagttttttgagagttattttttttatagttaaaaggatatagaaataaaagttaaattataaaattgattaatattatgtttttaaatattatttgtattataatttttaaaaaattatgttttttagtttttttaaaaaatagaatttttaaaaatatttagtaatatttaaaaaatttttgtattattaatttttgttttttgtcgatttttaggaaaaatatatattgtattattttttattgtgttatttggcgttttttaaagaatgattatgttgtgtatgagaattatttgaattgtgaaaaatgtggatttataggttatatttttatattaaatgttaatttgatttttggggtttggatttaagtatttagatttttaataaatattgtagatgatttttttttttaaggtttgggaattattggtataagcgatttttagttttttagatagatataagattttgaatgttaattaaaatggttgttaatttgtgaataatttttaattgaattttaggtaatttaaagagataaaaaatttattgtgaaaaatataaataatagtgtaaaataaattgttaattgattttttagaattattaataatataattgttttgtagaaaattttttaaagttgaaatttaaaaaatattgtttttaaaaattattaagatagttattataaaatatgattatatgttatgggatgaattatatttttttaatatttgtatgttgaaattttaattttcgggtttttgggaggtgattaggtttagatgaaatcgtgaagattgagtttttagatggaattagtgtttttataagaaatttgagagtttatgttgtttttgttttgtttgtttttttttttttttttgttatttgatataatgagaaagttataatttgatagttaagaagggggtttttattataatttggttatggtagttttttgatcgtcgatttgtagtttttagaattgtgagaaaattaattttcgttaagttatttagtttatggtatttttttaaattaagatattatagaagtgtaagttttaaaaatattaatatatttagtgttattaatttttgtttttgtatatataatataatgttttgttataaagttaaaaataaattagaatttttttaatttagtatgttttaagaaatattatttgataataattaataaaataaatttgtaaaatttgttaatgatgtgttttatgttaaattaaataaagatagttttttttggataggttgttggaaaatggttgtattaattgaattttttatgttttattttagatttttaattttaagttttgtttatagatttgattaaaataaaggttattatgaataggttattaataaaggttataaagttttgtgtttatgatgtgttataaatggtgtgtttagttttattagttaatgttgttgtatttgatgtcgttttagtgattttttttgttagtttattgttatttaaaattaagtaaaattttttttgtatgaaatttttttgattaattattgttatatagaatttttatttatttaattttttttttttttatttgagatagagttttgttttgttgtttaggttgaagtgtagtggtggtatttcggtttattgtaatattgtaacgtttgttttttgggtttaagagatttttttgttttaggttttggagtagttgggattataggcgggtattattatttttcgttaatttttgtatttttagtagagacggggttttattatgttggttaggttggtttcgaatttttgattttaaatgatttgtttgtttcggttttttaaagtgttgggattataggcgtaagttatcgcgtttggttttattcgtttaatttttattgtttattatatttaaagtgttgagtgtgataataagttatttaaaatttagtttggatttttaagagtttgtaatataatgaggaaaaaattttaacgatttttttttatttagatttttataatgttatttgttattaatagtttggaatattattgaagtttaagggtttgtggttatttaatattttaaatataatataatttggtttaaataagatattaagaattttggttaagaattttggttaaatataggagatttggaatttaacggtatgtttttggtaatttataatttttttttttatacgtttttttatgtagaaagtaaaggttttggaaaggattgatgaaaattaattttaaaattttacgatgtttttttttgtatttcgaatttaaaagggtgagttatgaagtaaaattttgtatttggtttaagttattgaaatatttgtaaacgatgttagagttcgaaaagagtaaagatagtagaaatcgtttagagaaagtaatttattgttgaagttttgtaaatttgagtagttaattaattttatcgtttataaacgtttggtcgttaggtattgtgattttttgtttagataaaagttttttttttttttgttttttttttttttttttttttgttttgtcgcgtgagattattatttttcgggttagttcgcgaacgttagggaggcgagtgtgaaatatacgcgttaatattttttttttttttcgtgcgttttttttttttatagaaaaatgtgtttttaggtaacggcgggcggcggcgttattttttgttatttaaatttaggtttttatttttcgtagtttttttttttcgtttttattttttttttttcggtcgtgggttttatttacgttttttcgggtttggggagggggcggaggttcggcgtgataagcggtttagattttcgtgggcgtcgtatatttgttgtttgtagtagttagcgattcgtattatcgttttcggcgggcggggaagcggtcgtagcggagtcgattcggtaggtggtcgcgggcggggtcggcgagcgaaagtgcgcgggggttcgattatcgcggggtcgggacgcgatggcggcggtagagttcgcgagttcgggttagtaggcgtcggtagggtaggggtagggttagcggtcgtcgtcgtagttttcgtaggcgtaagtttcgtagtcgttttcgtcgtcgtagttcgggggcgtcgggggcggtagtagtaggtacgagaagagtttggggttgtttattattaagttcgtgtcgttgttgtaggaggttaaggacggcgttttggattttaaagcggtgagtttcggaggcggggacgggggcggatttcggaattcgtggttttcggggaagtttagtttttcgtcgcgtgggtttagcggcgtggtgtagacgcgttttgcggggattcgggatcgggtaattcgaggattatgtggtttgcgttcgggtcgtggacgtcgggatgggggagggacgagggattaggatggtatcgagcggacgcgtaattaatggggttcggcgttacgttgggttttcgataaagagtttaggatttcgagcgcgttcgcgtggtttttgttttcgggcgtagggatttgagggtaatcgagtgtttgttgttttgcgtttatttgtggtagaggtttacggggtaacgggcgttttgttcggagatatcgtggatatcgattttgttgttaagaatggatggttttaataggcgattttagttggaattatgtttttgtagtttaaataaaaaggaggaaaaataaaatttagtttgttatttttattagatgaaagaaaaaaaaaaaagagtatttttttttacgttttttttcgataaaatagtattaaattttttttgtgtattttttttattattttgatagttaggaggggtatttgatttgtgattttatttggtatgtgttatgggtttttaaaagtgagatttgttgttatacgaaaaggggatattttataatttttatttaaagaggtggaagtgtttagtaaattttttttttgcgtcgttttttatagcgtttagattttttaaataggagtaggtattaaaagttgttttgttatatagaatgatttaatcgatttaggaaggatttggaagaatttaatagcgtttaggataatgagaatgtggttatttcgcgcgaagtttaagaattaaagttttagaaataaataaataaaaaatattaattgtttaataattattgtaaattttttttgattttttaaatgtggttttatttggaggattggttttagtttttaggggagtgtttggattattttatttggtttgagagtgttattgtatttttaaggttttgtataaagtagtggtagttttttgaatgtaaggattaagatttgtaggggttaatttttttgttagaagtttttttttagtgtagtttaaggggaagtagatttttttagtgtttttttttttttttggatgtagttggtgtttaattagtgattgttgaattgaattatttaaattgtttaattttatataattgaggtatgttgtatatattttgtattttggtaagtaatttttattattttttttttgatatgttatttttggaattttttttttatttttggaaattttttgtttttttttttttattatagttttttttttttttttttttttgaaagtgatttatggtatgtgtagtatttaaattgtagtgaattaaaatggattttgtttaaagaattttataggaagttatgaagttattagagaaagttaggaatgttataaagtataggtggtaaattgttgtttaaaatttagaaatttagttgtagtttgtgattttggtgtaagaaaattagggaagtttggggttttttaggtaaaattgaattttgacggttggattttgagggttttttttttagtttgttttaggatatggtggaattttgtttttttttgatttgaaattttttagtttttttttgttttatttgtggttatataattgttttatagaagttatagaggtagtgagtaggatgtaaagtttggtattttatgataataattgttttatttattttggaatttttttaaaaatttaaaggtttttataataatattgttttattatattaatgattttatatttttagaaaagagtttgaatgtttttagtttttatatatatgtatgaaaaatatatgttttatgtattttacgtatattttttatttatttatatatatttatatatgtaaaaatttttttttttttttttttgagacggagttttgttttgtcgtttaggttggagtgtagtggcgcgatttgggtttattgtaagtttcgtttttcgggtttacgttatttttttgtgttagtttttcgagtagttcggattataggcgttcgttagcgtatttagttaatttttttgtaattttagtagagatagggttttattgtgttagttaggatggtttcgattttttgattttgtgatttacgcgtttcggttttttaaagtgttgggattataggcgtgagttatcgcgttcggttaaaaattttatattgaaatttttttaatgatattttttattatatattatagtaaaagatcgttaaagttttttttttttgagattgagttttgttttgttatttaggttggagtgtagtggtagatttttgtttattgtaatttttatttttcgggtttaagcgatttttttgttttagttttttaagtagttgggattataggtgttcgttattatgttcgatttatttttgtatgtttagtagagaaggggttttattatgttggttaggttggtgtcgaattgttaattttaaatgatttgtttgttttagttttttagagtgttgggattataggcgtgagttattatatttagtttattaagatatgtttgataatatatattaaagatggatttatattgataattataaatttnttttaatttgaaattataaagatatatttttttttgtatttttattttggtgggggtatattttagtataatttttttgaaattttttagttttttaaagtaaatgtgattaagaaatatatatatttatttaatagttatagtggtaagtatgggttgggaatggtgatttgttttgttttttatttattttttgtttgtatttaggtaattgtttagggttggaggaaaatgtaaaataatgttgataggttttattttaaatttatgattattaattataaaggggttagtagtgttgtttagcgttttttttatgttatttattgttttgtttttttatatgaatattttgtatttttttttttttttttaattattaatagtttttttttttttttttcgattttagtgttgatgagagaataaaaattaattagaaggaaatgtttaatttttttttttatttggtttattaatgtatttatatttgtatttaggtattttgttggattttagttattaatatgttttgttattatttaaggatagtttttatttattgaatttatattttgttttttttatttattgttatttttagtagttatttttttttttttttgtattgttaatgatttttttttttttattagattatttttattagtatatttatatgttgaaatagtttttatttttaaaaggaaaaaaaaaaattttttggagattttatagttttttaaaaatattgttttatttttttttatttttttgtagtagaattttttaagagttgtttattttagttttttttttatttttttttgaaatttttttattaagatttttagttttatttttttgttaaaatagttttgattaaagttatttatgatttttttaaaggtaaattattgattagtttttattaatttgttttgatagtaatatttgatatggttatatttttttatattttttttttttggattttaagattttatattttttgatttttttttgattttagtggtaggttgtttttttattttttggattttaaatttttttagagttggtttttaatttttttttatatgtttattttttatgttaaattagtggattttattttgtggtataaattgtttattcgttgaagattattgaatttatatttttagtttggattttttttttaagtatatattttcgtgtttagtggttttgttttttttttgtggatgttagaaggtttaaggttagtttttttatttttagtgttttaaattggttttttttgtagtatattttatttgtaattgtttttattaaaaattgaagttatttttgatttttttttagggatttgttgtttgttatatttttaaaatatatttagaatgttaatattttttattatttttatagttatttttttatttaagttattattattttttgtatggattattgttatcgttattttgttggtttttttttttgtttttattttttttttttatttttttttttattattttgttatattggtttgtttgtttttttttgaagaagttaagtattttttatattttagaattttcgtgtttgttgttttttttgtttagaatgttttattattaaatatttataggggttttttattttatttaaatgtttagatgttattttgttagagagttttttttttgaaaattttatttgatatagtattttttttttgtttgtattttttttaaatataattatttgtatattattaattttttttttttttttgagggtagggattttgttttgttatatttatatttttaagatttagaattaagtttggaatattttggtgttaaatgaatggaggaaggtagtggtgatagtggtggtggtggtggtggtggagatttatggtattattttgttagatattaaagttttaaattagtttttaaagaatttatatataatttttttaaatattatataaaataaggtaaatttgtatatatataaattttaattaattttaaatatagttttatttacgattcgttttaatttgtatttgatgatgaggttgattagttaatatttaagtaattattatatagtagatattgcggtaagattatttagtttaatttttataatattttttttagtatatgttatattattttatgaaaaaggaaatgaggtttagtgagtttacgatgaggttagttgaagataggaagtggtagttttgggattggattttagtgtgtttagttttagaattttttaagaatgatgggattggttgggtgttatggtttatatttgtaattttagtattttgggaggtcgaggtgggtggattatttggggttaggagtttaagattagtttggttaatatggtgaaatttcgtttttattaaaaatataaaaattagttagtcgtggtggtatatatttgtagttttagttatttgggaggttgaggtaggagaattagttgaatttaggtggtggaggttgtagtgagttaagattatattattgtattttagtttcggtaagagagggagattttgttttaaaaaaaaaaaagaatgatgggattttttaaaataaaatttttttggagatttttttatatatgatttgtatatgttagttatttatatgtttatatatttaaatagtaaagtatttgagaaataatgtttagttttagaaattaggggttaaatgttgtgattgttaagtagtaataaatataaatgataaataagatatttttttaaaattttgagttaaaaattaaattttatggtattttgtttaatgatttaagttagattttgtggtttggtttatataaatatgttttgatattaaaattagagtgttgttgttatggttgtgaatgtttttttgtgtgagtatatagatattagtaatatagagttatggtttggagttttttgagttatttttttagagagaggaaagtgagaaatgaaattttagttttagatttgtatcgttaattttgtagtcgtgtattgttttttataaaaatagtttcgaagttaagagtaaaaattttgtgaaggtcgataaaataagaagggaattgttaagtataagggaagaaggtattaatgaaataaattatggttagttttgttgttaattttttggttttttagaagggatagtgttaagttagagttggggaataaagagttttatttttttgttttttttttttttgttatattttgtttatttttttggtttattgaggtatgaattttttttttgaggaagatttgaatgatgggatagtagtaatttgggggttttggtggtatatataaaaaaatgtgtttgagagaattgatattttttttaagattttaaatgtttgtatagtgaatatagttgttagtggtattttttttggggggaaggtaggtttagattgtaaatattgtgttgagttaggtttttatagaattaagaaagtagtgatgttttttgggagagttgttagtaattatgcgaagttgggagagttgttagtaattatgtgaagttaaattttgtttatttagatattttagataatgtgttgaaaattgttagtagagatataaatatttgtaattattatggattttaaaatgtggttttatatttaaaataggttattgtttaatttattttgaaaatttttttgaggttttttttgtttttttgggaatatatattaaaaatgtgaattggaattaattagaggaattgtttgttgaatttataatatgatagtatatattgttttgttgattttatttaatgtgaatgtagttattaagtttttgtataatagttgttagtgtaattttgagttattgattttgattttttgttgattttatgttttgtgttaggatggtatgatttatttttttgttttcgttattaatttaaaaatgtagatatttattttaaggtattataagtgtgtatatagtttagaatttttaagtgttttaattattaaaataaattgttgagatgtaattttttaaaattttaaaaaataagtaatgtatttttagatgagattgtttatgaatagagaaataagataggaggtgatatggataggtaattagtagtttttttttaggattagtttataaggtgatataaagtatttttattgtgtttttttatttttgtaggttttgtgttatgattttaatttttttttttgttttaatatttgttagtttttaaatggaataatttttttggtatttgtagtgtttgggagatgttttgaatatgtttagttattgtttttaagtaattgagtgggttaaatttgagattggatttgttgtggatttaataattaattttttttggttttaaaatatgatttgttttttattttattgttttcgttgttttttttgaatagg

SEQ ID NO: 36 - DNA, 12405 bp, Artificial Sequence
  chemically treated genomic DNA (Homo sapiens)
  unsure (4511)
tttgtttaggaaagataacgagaatagtgaaataaagggtaagttatattttaaagttaaaaagggttgattattaaatttataataagtttaattttaaatttgatttatttagttgtttggggataatagttgagtatgtttaaagtattttttaaatattgtaaatattaaagaaattattttatttaaaagttagtagatgttggaatagaaaaagaaattaaggttatgatataaagtttgtaaaaataaaagaatataataagaatattttgtgttattttatggattaattttgaggaggagttattaattgtttatttatgttattttttattttatttttttgtttataaatagttttatttaaagatgtattatttattttttaaaattttaaagaattatattttagtaatttattttggtaattaagatatttggaaattttgaattatatgtatatttataatattttgaaataaatatttatatttttaaattaataacgaaaatagaggaatgaattatgttattttaatataaagtataaaattagtaagaaattagaattaatagtttaagattgtattagtaattattatataaaaatttggtagttgtatttatattagataagattaataaaataatatatgttattatgttatgaatttaataaataatttttttgattagttttaatttatatttttgatgtgtgtttttaaaagaataaagagaattttaaagaagtttttagagtggattagataatagtttattttgaatgtggagttatattttaagatttatggtagttataaatatttgtgtttttattgataatttttagtatattatttaaaatatttaaatgaataggatttagttttatataattgttaatagtttttttagtttcgtataattgttaatagtttttttagagagtattattatttttttgattttgtgaaaatttagtttagtatagtgtttgtaatttggatttgttttttttttagagaaggtgttattgatagttatatttattgtataggtatttgggattttaagagaaatgttagtttttttagatatatttttttgtatgtgttattaaaatttttaggttattgttgttttattatttaggttttttttaagaaggggatttatgttttagtggattaggagaataagtaggatgtggtagaagaaggaaaagtaggagagtggggttttttgttttttaattttaatttggtattgttttttttagagaattagaaaattaatagtaggattagttatggtttgttttattgatattttttttttttgtatttagtaattttttttttgttttatcgatttttatagaatttttatttttgatttcgaggttgtttttatgaagagtaatatacgattgtaaagttaacggtataaatttgaagttgaggttttattttttatttttttttttttagagaagtaatttagagaattttaagttatggttttgtgttattggtatttatgtatttatatagaaaagtatttatagttatagtaatagtattttggttttggtattagaatatgtttgtatgaattagattataagatttagtttaggttattaggtaaagtgttatgagatttaatttttagtttaaagttttaaaaaggtgttttgtttattatttatatttattattgtttaataattataatatttaatttttagtttttaaaattaaatattattttttaaatattttattatttaagtatgtaaatatataaatgattaatatgtatagattatatgtaaaagaatttttaggagggttttattttagaaagttttattatttttttttttttttgagatagagttttttttttttgtcgaagttggagtgtagtggtgtgattttggtttattgtaatttttattatttgggtttaattgatttttttgttttagttttttaagtagttgggattataggtgtgtattattacgattggttaatttttgtatttttagtagagacgaggttttattatgttggttaggttggttttgagtttttgattttagatgatttatttatttcgattttttaaagtgttgagattataagtgtgagttatggtatttagttagttttattatttttaagaagttttgaagttaaatatattgagatttagttttagggttgttattttttatttttagttggttttatcgtaagtttattaagttttatttttttttttataaaatggtataatatatattgaaaggagtattgtgggaattaaattggataattttatcgtaatgtttattgtatagtgattatttaaatgttggttagttagttttattattaaatataggttgaaacggatcgtgggtaagattgtgtttaagattggttaaagtttgtgtgtatatagatttattttgttttatatagtgtttgaaaaagttgtgtgtgaattttttaaaaattaatttggggttttaatatttaatagaataatattatgaatttttattattattattattattattattattattatttttttttatttatttaatattaaaatgttttaggtttggttttgggttttaaagatatagatgtgatagaataaagtttttgtttttaaagaagagagggaagttaataatatataaataattatgtttggagagaatgtaggtaagaggaaggtgttatattaaataggatttttagggaaagagttttttgataaggtgatatttgaatatttgaatggagtaggagatttttgtgaatgtttggtggtagagtattttgggtagaggaagtagtaagtacgaaggttttgaagtgtgaggggtgtttagtttttttaaggagaggtaggtaggttagtgtggtagaataatgagagggaaaatggaaaaaggagataaagataggaaaggagattaataagatggcgatggtaataatttatgtaggagatggtagtggtttggatggaggggtagttatgaagatggtgaaaaatgttaatattttggatatattttgaaggtatggtaagtagtaggtttttagagaggaattagaaatgattttagtttttgataagagtaattataaataaggtatattatagaaggaattagtttggagtattggaaataaagaaattggttttgaattttttgatatttatagggagaaagtaagattattggatacgagagtgtgtgtttaggggagagatttaagttagagatataaatttagtagtttttagcgaatagatagtttatattataagatggaatttattagtttgatataggaggtgagtatataagggaaggttaagaattaattttggggaagtttaaggtttaggaaatgagggagtaatttgttattgaagttagaagaaaattagaaagtgtggggttttggaatttaagggaagagagtgtaagaaagtgtgattatattaagtattgttgttagagtaagttagtgagaattgattagtgatttgtttttggaaagattatgggtgattttgattagagttgttttggtagagaggtggggttgaaagttttaatggagaaattttaagaaagaatggaaagaaagttagaatagataatttttgaagagttttgttgtaaagaggtaagaagaaatggggtaatatttttagggaattgtggggtttttaggaagtttttttttttttttttaaagatgggagttattttaatatgtgagtatgttgataggaatgatttggtaaagaaagaggaattattaataatgtagaagagagaagggatgattgttagaggtggtaataagtagggaaggtaggatgtgaatttaataagtgaggattgtttttagataataatagggtatattaataattgaagtttagtagagtatttgggtatagatataggtatattagtagattaggtagggagaaaggttagatatttttttttggttgatttttatttttttattagtattgggatcggggagaaaggaaaggagttattaatggttgagaggagagaagaaagtataaaatatttatataaaaaagtaagataataggtagtatggaaggaacgttggatagtattattggtttttttgtagttggtgattatgaatttaaagtgagatttattagtattattttgtatttttttttagttttggatagttgtttgggtatagataaggggtaggtggagagtaaagtaagttattatttttaatttatgtttgttattgtaattgttgaataagtatatatattttttaattatatttattttaaaaggttaaaaagttttaaaaaaattatgttgaaatatgtttttattaaagtaagaatataagagaaaatgtgtttttataattttaaattaaagnaaatttataattgttagtgtgagtttatttttaatatgtattattaaatatgttttaatgggttgggtatggtggtttacgtttgtaattttagtattttgggaggttgaggtaagtagattatttgaggttggtagttcgatattagtttggttaatatggtgaaattttttttttattaaatatataaaaatgagtcgggtatggtggcgggtatttgtaattttagttatttgggaggttgaggtagaagaatcgtttgaattcgggaggtggaggttgtagtgagtagagatttgttattgtattttagtttgggtgatagagtaagatttagttttaaaaaaaaaaggttttaacgattttttattatggtgtataataagaaatattattggaaagattttaatgtaagatttttggtcgggcgcggtggtttacgtttgtaattttagtattttgggaggtcgaggcgcgtggattataaggttaggagatcgagattattttagttaatatagtgaaattttgtttttattaaaattataaaaaaattagttgggtgcgttggcgggcgtttgtagttcgagttattcgggaggttgatataggagaatggcgtgaattcgggaggcggagtttgtagtgagtttagatcgcgttattgtattttagtttgggcgatagagtaagatttcgttttaaaaaagaaaaaaaaaagatttttatatatataagtatatataaataaatgaaaaatatacgtaaaatatataaaatatatgttttttatatatatatatgaaaattaaagatatttaaatttttttttaggagtatgaagttattaatataatgagatagtgttattgtagaaatttttgaatttttaggagagttttagaatgaataaagtaattattgttatgaaatattaaattttatattttatttattgtttttgtgatttttgtagggtaattatatagttatagatgaaataggaggaagttaaagaattttaagttaagaaagggtaaagttttattatattttgaggtaagttgagggagaagtttttaaagtttagtcgttagagtttagttttatttggaaaattttaaatttttttgatttttttatattaaagttataggttatagttgaatttttagattttgaatagtagtttgttatttgtgttttgtaatatttttggttttttttgataattttatgattttttgtgaaattttttaaatagaatttattttaatttattataatttaaatattatatatgttataaattatttttagggagagaaaggaagaaggggttgtggtggaaaaaagagaataaggaatttttagaggtgggaaaaaaattttaggaataatatattaaaaagaaaatagtagaaattatttattaaaatgtaaaatatgtgtagtatgttttagttgtatgaagttgaataatttaggtaatttagtttaataattattgattgaatattaattatatttagggaaaggagagggtattgaaaagatttatttttttttgggttatattggaggagggtttttagtagaagagttggtttttgtaagttttggtttttatatttagggagttgttattgttttatgtagagttttgaggatgtagtgatatttttaagttaggtaaggtggtttaggtatttttttgggagttggggttaattttttaagtaaggttatatttagggagttaaaggggatttgtagtgattattgggtagttagtgttttttgtttgtttgtttttaaaattttagtttttaaatttcgcgcggagtgattatatttttattattttgagcgttgttgaatttttttaaattttttttagatcggttaagttattttgtatgatagaatagtttttgatgtttgtttttgtttgaaaaatttgaacgttgtaaaggacgacgtagggagagagtttattgagtatttttatttttttgggtgaaagttgtaaaatatttttttttcgtgtgatagtagattttatttttggaaatttatgatatatgttaaatgaagttataaattaaatattttttttaattattagggtgatgaaagaagtgtataaggaagatttaatattattttatcggggaggggcgtggaaagaagtattttttttttttttttttttatttggtagagatggtagattgggttttgtttttttttttttttatttaaattataggaatatggttttaattggaatcgtttattaaaattatttatttttaatagtaaaatcgatatttacggtgttttcgggtaaagcgttcgttatttcgtgagtttttgttataggtggacgtagagtaatagatattcggttatttttaggtttttgcgttcggagatagaagttacgcgggcgcgttcgaggttttgggttttttgtcgagagtttagcgtggcgtcgggttttattggttacgcgttcgttcggtgttattttggtttttcgttttttttttatttcggcgtttacgattcgggcgtaggttatatggttttcggattgttcggtttcgggttttcgtaaggcgcgtttatattacgtcgttagatttacgcggcgaggggttgggttttttcgggggttacgggtttcgaagttcgttttcgttttcgttttcggagtttatcgttttgagatttagaacgtcgtttttggttttttgtagtagcgatacgaatttggtagtgagtagttttaggtttttttcgtgtttgttgttgtcgttttcggcgttttcgagttgcggcggcgggggcggttgcggggtttgcgtttgcggaggttgcggcggcggtcgttggttttgtttttgttttgtcggcgtttgttggttcgagttcgcgggttttgtcgtcgttatcgcgtttcggtttcgcggtggtcgggttttcgcgtattttcgttcgtcggtttcgttcgcggttatttgtcgggtcggtttcgttgcggtcgttttttcgttcgtcgagagcggtagtgcgggtcgttggttgttgtaaataataggtgtgcggcgtttacgggagtttgggtcgtttgttacgtcgggttttcgttttttttttaagttcggggaagcgtgaatgaggtttacgatcgaggggggaggggtggaaacgaggagaaggggttgcgaggggtggggatttgagtttaaatggtaggaagtgacgtcgtcgttcgtcgttgtttagaaatatatttttttgtaggaaggaggagcgtacgaggaggaggaggggtgttggcgcgtgtgttttatattcgtttttttggcgttcgcgagttgattcgaggagtggtaattttacgcggtaaagtagggaggaagaaaaaaaggagataaaagaaaaaaagatttttatttgggtagaaagttataatgtttagcggttaaacgtttgtgagcggtgaagttggttgattgtttaagtttgtagagttttagtagtaggttattttttttggacggtttttgttatttttgtttttttcgagttttagtatcgtttgtaaatattttaatgatttggattaagtgtagagttttattttatagtttatttttttagattcggagtatagaaaaaggtatcgtggagttttagggttggtttttattaattttttttaaggtttttattttttatatggagaaacgtgtagagggagaggttgtgaattgttaaagatatgtcgttagattttagattttttgtgtttgattaaagtttttgattaaagtttttaatattttatttgaattaaattatattgtatttggaatattgggtagttataggtttttggattttagtgatattttaaattattgatggtaaatgatattatggagatttgagtaaaagaaagtcgttgggattttttttttattatattataaatttttgagaatttagattaaattttaaatgatttgttgttatatttaatattttgaatatagtagataataaagattaggcgaatgagattaggcgcggtggtttacgtttgtaattttagtattttgggaggtcgaggtaggtagattatttgagattaggagttcgagattaatttggttaatatggtaaaatttcgtttttattaaaaatataaaaattagcggggggtggtggtgttcgtttatagttttagttattttagagtttgaggtaggagaattttttaaatttaggaggtagacgttgtagtgttgtagtgagtcgagatgttattattgtattttagtttgggtaataaagtaagattttgttttaaataaaaaaaaaaaagattaggtgaatgaaaattttatatggtaataattaattaagaagattttatgtaagaaagattttgtttaattttaagtaataataaattaataaaaaaggttattgaagcgatattaaatataatagtattaattagtaaagttgaatatattatttataatatattataggtatagaattttataatttttattaataatttatttataataatttttattttaattaaatttataaataaaatttaaaattgaaaatttgaagtaaaatatgaaaaatttagttgatataattattttttaataatttatttaagaaaggttatttttatttgatttgatatgggatatattattgataagttttgtaaatttattttattgattattgttaagtagtattttttagaatatattgaattaggaagattttaatttgtttttaattttataatagaatattgtgttatatgtgtagggataggaattaataatattaaatgtattaatatttttaaaatttatatttttatggtgttttagtttgagaaagtattataaattgggtgatttaacggaaattaatttttttatagttttggaggttgtaagtcgacgattaggaggttgttatggttaggttgtggtgagggttttttttttggttgttagattgtggtttttttattgtgttaaatggtagagagagagagaaagatagatagaatagagatagtataagtttttagattttttataagggtattaattttatttgagggtttaatttttacgattttatttaaatttaattattttttaaaggttcgagggttagggttttaatatataaatgttggggagatatagtttattttatggtatgtaattatattttatagtagttattttggtaatttttaaaaataatattttttaaattttagttttaaaaggttttttataaagtaattatattattagtgattttaaaaggttaattaataatttattttgtattgttatttgtgttttttataatgaattttttatttttttagattgtttggggtttaattagaaattatttataaattagtagttattttaattagtatttaaaattttatgtttgtttgaagagttaaaaatcgtttatattagtggtttttagattttaggggaaaaaattatttataatgtttgttaaaaatttagatgtttggatttaaattttagggattaaattagtatttgatatgagaatatgatttgtgagtttatattttttatagtttagataatttttatgtataatatagttattttttgagaaacgttaaatagtataatgaaaaataatgtaatatatattttttttaaaaatcgataaaaaatagagattgataatgtaaaagttttttaaatattgttaaatgtttttaaaaattttattttttaaaaaaattaagaaatatgattttttaaaagttatgatataaataatgtttaagaatatgatattgattagttttgtaatttaatttttatttttgtatttttttgattataaaggagataatttttaaaaggttgtaaatttttatattagttttttgtgttatttttgataaaggtttaaaaattatttttaataaaagttaaagttggttgagtgtttacgtttggttgggtatttacgtttgtttgtaattttagtattttggagggttgagagaagaggattgtttgaatttaggaatttaggattagtttggataatatggtaaaattttatttttataaaaattataaaaattagttgggcgtggtagtgtatatttgtagttttagttattagagaggttgaggtgagaggattatttgagtttaagaggttaaggatgtagtgatttgttattttgttattgtaatttagtttgagtgatagagtgagaatttattttaaaaaaaaaaaaaaaaaaaaaaatttaattgaattaaattatattttattgatttataagggtaataaatgtataatagtaattttttattaaatttaatttacgttgattagttgggtagatattatttttaattataatattgtttatatgtttttggttaaattttttttttttaaatgtattttggaagtgtagttttttagttagtttaggattaagaaggaaggtttaaatattttaaaatagaatgattttttagtttatagtttattaaatttatagtatttaatatttgtggaattttataaatgttatttttatagagatttaggattaatttaaaatatgtatagttttgttataatttggtagttaaatatttaagaaaatttaataaaattttatttgtttattgatgatgatagattgattttttttttttttttttgaaatggaattttgtttttgttgttttattttggaatgtaatgggtttattttaatgagaattaaaataaaaattgaaagaatttgtttttaattgagttatatggtattttatgttgatttattttatgatgaggtttggattaattattatttaattttaaatattgttaaagataatttatatttttagatgttaatgtagaatgttttattttaatttataattaagaggaattttttataagttagtaataggataattgtgtaatagaattttatagagatattatttaatttaatgtttatggtagttttagtgttttttttgttatattggaaatagatttataaagttaatgaatgattaaggtggaatttagtattaattgtatatttataaatatatttgtggtaaaatatttttaaatggatttatatgattttaaatgattttaaataaatttggtatatagttaaaagtttttaagttatataattgtattgaagaagtaatttaaataataatggtttataggaagttttatattaagtgtataaaatggtttgaaaaaatagaaagattttaatttttatttattattgaaaaataataaatagtaataaaaaattgtatatatgtttaaagttttgggattgtgattaatattttatagaatgaggtttaaaaaatgaaatagtatttaaagtagataaaatgttataagagatagaaaaatgagagattatttaaggtgggagtaaataggaaatagtttttggaggtggttattatgtgtttttaatgggtttgtaagggttattaaattaataaggaaattaaatataaaagaataaataatttattttaaagacgtaaagcgttttttttaggagtcgtatgttttaatttttagttattattttattataaggaaatttttttttaaaaaatttgtatgggtcgttttgttattttaaattaattgttattgtatttgatatttttgaaatgtataagttttaaatttttaaaaaaaaatttttaaataaattttgtataaatttttaaaaaag

SEQ ID NO: 37 - DNA, 5867 bp, Artificial Sequence
  chemically treated genomic DNA (Homo sapiens)
  unsure (1053, 1055)
tttgtttagtttttcgagtagttgggattataggtatttgttattacgttttgttttttttttttttttttgtatttttagtagagatggggttttattatattggttaggttagttttgaacgtttgattttaggtgatttatttattttgtttttttaaagtgttgggattataggtgtgagttattatattaggttataattttttttatttataaattggggatattaatagtatttatttttatagtaattgtaagaattaaattagttaatatgtataaaatatgtagaatggtttttgtttgggtttgagattagtaaatattataattattgaaagaggggatggattaatggttggatgataaagaaatagaggtatgtttttgtttttaatgagtttttttagtttttattattttttatttgtttttaagttagttttagttataagtgtgattaatttttttgattaggttatatgaaaacgttattttttatttgttaagtagatattaaggtaacgatgtttaaggatgttttttatttttattagggtttgggtgaattttttatttttaggtaaattttaaaaaattaagtaagtagttaggtatggtggtgtgggtttgtagttttagttatttaggaggttaaggtaggcgaatttttcgagtttaggagttggaggttatagtgagttatgattatgttattgtattgtagattaagcgatagaatgagattttttttttgaaagaaagaaagaaaaaataaaaaagttgggtggggtgatttttatttgtaattttagtattttgtgaggtcgaggcgggtggattatttgaggttaggagttcgagattagtttgattaatacgatgaaattttatttttattaaaaatataaaaattagttaggtatggtggtgcgtgtttgtaattttagttatttaggaggttgaggtaggagaattgtttgaattcggaaggcggaggttgtagtgagtcgagattatattattgtattttagtttgggttattagangncgattcgtttttattatcgttaaaaaaaaaaaaaaagtaagaaaatatagtgtaagtttaaattagaaaagaagaaagattaaggtatattaggaagacggttggaaaatatatgaattatagaatgatttttaatatttaagggtaggtttttatagttaaaattgattaattttttttttcgggttaagtaatttttcggtttagttttttaagtagttgtgattatagtggtatatcgattaagtttggttaatttttatatttttagtagagacgggagttttattatgttggttaggttggtttcgaatttttattttaggtgattcgtttgattcggttttttaaagtgttgggattataggcgtgagttatcgtatcgggttattattttttttttagaggtagttatagtagatgaaaagatttaaaaattatttttacgtgtaagttatggtaaaatgtaattatttaaggttgttttaaattagattaatagtagagtggttagattatattgaaagtttggtgaattataattaagtattttaaagaattatttttgtttgttttatttttatgtaaataattgaaatttttgtttttttttttaaaaggggttatgttgatttttatttataatgtattttaagtttgttattttaaatggttatgagtaagtttaagaaaaatttttagtaaatattattttagattatgattttaaaatatatttacgagttttaatatcgttattgttatcgttttaatatttaaggtagtaaaaagtatattggatttttgtaaaggcgtaggggtgcggggaattcgttatgattatgttgaaaatatagggtttggggaaaaagggatttaaaataagaagaaaaagaagatttgggatttaaaaagttttttagaggttagtttacggtgataaaaatcgatttttatttcgagttacgtgaggttttttgtttttttttaggttttttttttcgtagttagaaggcggaagaaaagttattttaaggtggggcgagtggtagggcggattttggcgatttgacgttgcggaggttcgagcggcgtatttatattatttagttgttcgtcgcgggaattcgtcggttcgtaggtgatttagcgttggaaaaacgttagcgacgtggtttggcgagttggcgcggggtaaggattattcgcgttcgttttgtcgttttagtttttttttttaggaagtagggtgcgtttcggtgcgcgcggggttttttcggatcggcgttttagttttttttcggttttcgtttatttcggttttattgagagtagaaatgtgatttttgttttgagaaaatgttcgtggttagtgattatttttaacgtataataatatggtttcgatgggtttaaaggtattggttttttgttttgttttgagataaggttttattcggatgtttaggttggagtgtaattgcgtgattttgatttattgtaattttcgtttttcgggtttaagcgatttttttgttttagttttttaagtagttgggattagtaggtatgcgttattacgttcggttaattttgtatttttagtagatagggttttattatgttggttaggttggtttcgaatttttggttttaaattatacgttcgtttcggttttttaaggtgttggtattataggcgtgagttatcgcgttcggtttagtgttggtttttaaacgcgagaattgagatttttttttatttaatgaaagtttcggttattatcgtaatatttagaatatttagtttgtgttgtataatatgttatttaggtataaattaaggatttatgtaattttgttattttttgcgtgatattttaaaaaatattttgtgtaaggtatttataaagcgtttattattatcgtaattataggggtttgaggaaaaattttgattgtggttcgggtatcgtggtttacgtttgttaattttagtattttgggagatcgagtcgggtggattatttgaggttagtagttcgagattagtttggttaatatggtgaaattttcgttttttttaaaaatataaaaatttgtggggcgcgtttgtagttttagttatttgggaggttgaggtaggaggaatcgtttgaattcgggaggtagagtttgtagtgagtcgagatcgcgttattgtattttagtttgggtaatagagtagaatttcgttttaatagaacgaaatataaagaaagatagaaaatataagtggattgtgaaaattgaaaggattagaaaaattatattataaagatatagaaattaagaaagtattatagcgtttgtttttaattgttttttaatttgttttttttttttaatttgattgtggttttttttttagaaggaattttatagtatttagcgttggttatatagtaggtttttaaatatttgttaataaataagtttgttcgagaagttgggtaatgatattttatagttggaagaagaaatataatgatttagtaattagtttattaaaaataaacgtttttttttttttagaggagtattttttaaggtttgttttgatagttatttaaaaaggttaagtttatttaattttgttttagatttatgttaaaatgtagttataatcgataggatgatagaaaacgatagtatttatttaaatataataggtatttatttaaataggagaagttgtgattttatagtaagtgttggggttaggaaattgggtggataaatttgttgatgttgtagattttagtttttatatgagattatgtggaaaatttgaaagtattttaggttttttatgtttgtaattaaataattgtatattttttaatttaaaaagtattatgaggtatatatatatattcgtaggaattttttggcgtaataaaattagaattagatttaaagttaattgtaggattgagtttattttaaattgaaagtttggatatttggagtattagggggagatgacgtgttacgggtttttataaaagtagttggttttgaatggaaggagttaagaggttagtataggagcggattcgtcgtttttacggttatcgagtcgaatttttcgtaagttcgtgagtcgttaaggaggtttttagtttcgatttttcgttttaagtttttcggggttttcgggtttggtattttttgttatacgggaggggcgcggaagtcggggcggaggaggagttaatttcgggttgggttgagattcgtagaggaagacgttttagggatttgtttcggattagcgagatggtaaggttgaggacgggaggttgattgagaggcgaaggtatattttaattttaatataatttttggagttaagttagtaatggtagagggaagattttgtacgttttttttaggcggttttttcgttattattttttttaattcgtttcgatcggagttgagagtaatttatataaaaggattcgtttttgttttggggaattttagggatcgtcgttaaatttttattaacgtagaatttagagatcgttgcgttttcgtttttttattcgttcgttttcgttattattgaggtggagaagagtatgcgtgaggtttcggtgttcgttagtgggtagagcgtatatcgtttatagttttcgagaagttggggggaggggtcggtaattgaatcggtgtttagagaaggtggcgcggggtaaattgggaaagtgatgtcgtgtattggtttcgtttttttttcgagggtgggggagaatcgtatataagtgtagtagtcgtcgtgaacgttttttttcgtaacgggtttgtcgttagaatataggtaagtgtcgtgtgtggttttcgcgggtttggtttttttacgggttatggtttttgcgtgttttgaattatttttacgtttttggttgtagtacgtgatttttgatttcgagtttcgggttggaagtgggtgggagagttcgaggttttgcgtttaaggagttttttcgtttcgtgtttgagttgaggtttggtttgggcgttggggtcgtcgcgtgcgaatttggtggtattttcgcgtttgtttcgttgttttcgataagtttttagttatttaaaatttttgatgatttgttgcgacgttttttttttggtaagatagttttgtaaatgcgggttaagatttgtatattggtatttcggtttttggggtcgcgggcggcgacggggttcgtgcgttttagcgtatatgttcggcgaggcggggtttgcgagcgcggttatcgagaatcggacgggggtagttttaagttggtcggtttgttttggtgtttggtttcgcgtcgtcgtgtatcgtttcgttttgggcggtaaggttggttcggtcggtattagttgcgtgagcggaaagatggtcgtttttcggttttgttgtagggagtttaaaatggaggacgcggcgttcgggagagcgggcgggtgagttatttatataaaggaaaagggttttttcgtttttagtcgtcgttttatgtgattttacggagtatcgggcgtcgtttaggtatttcgattagttttcgagtttttggagtacgtcgtttttaggttggggggaggggttttatgcgatggagtttttttatattgagtgggtggagattgaagttaggttagtttggtatttgatgtaattttttttggaatttgttttttttgagtttggattttggtttatttttaagttttagatagtggtttaaagttttttttttttattttagg

SEQ ID NO: 38 - DNA, 5867 bp, Artificial Sequence
  chemically treated genomic DNA (Homo sapiens)
  unsure (4813, 4815)
tttgaaatggaagaaaaaaattttgaattattgtttgaggtttgagaatgaattaagatttaaatttaaaaagggtaaattttaaggagaattatattaagtgttaagttggtttaattttagtttttatttatttagtgtggggaaattttatcgtataaaatttttttttttaatttaaagacgacgtattttaaaagttcgagaattaatcgaggtgtttggacggcgttcggtatttcgtggagttatatgaagcgacggttgaggacggaaaggttttttttttttgtgtgggtgatttattcgttcgttttttcgagcgtcgcgttttttattttgagttttttgtagtagggtcgggaagcggttattttttcgtttacgtaattggtgtcgatcgggttagttttgtcgtttagggcggggcgatatacggcggcgcgaggttaggtattagagtaggtcggttagtttgagattattttcgttcgattttcggtggtcgcgttcgtaggtttcgtttcgtcgaatatgtgcgttgggacgtacgggtttcgtcgtcgttcgcggttttaaaaatcgaaatattagtgtgtagattttggttcgtatttataagattattttgttagaaaaaaagcgtcgtagtaggttattaaaaattttaaatggttagagatttatcgaaagtagcgagataggcgcgaaggtgttattagattcgtacgcggcggttttagcgtttaagttaggttttaatttaagtacgaggcgaaggggttttttaagcgtaaggtttcgaatttttttatttatttttaattcgaagttcgggattaagaattacgtattgtagttaggggcgtggaagtaatttaaggtacgtaagggttataattcgtaaagaggttaggttcgcgggaattatatacggtatttatttgtgttttggcggtaaattcgttgcgaaaaagaacgtttacggcgattattgtatttatatacggtttttttttattttcgggaaaaaggcggagttagtatacgatattatttttttagtttatttcgcgttattttttttaggtatcggtttaattgtcgatttttttttttaatttttcggggattgtgggcgatgtgcgttttgtttattgacgggtatcggagttttacgtatgtttttttttattttagtgatgacgagagcgggcgggtgagggggcgggaacgtagcgatttttgggttttacgttagtgggagtttaacgacggtttttgggattttttaaggtaggggcgagtttttttgtatgaattatttttagtttcggtcggggcgggttggggggggtggtgacggggaggtcgtttggaagggacgtgtagaattttttttttattattgttggtttagttttaaaggttgtattgagattagggtgtattttcgttttttaattagtttttcgtttttagttttgttatttcgttagttcgggataaatttttagagcgtttttttttgcgggttttagtttagttcggggttggtttttttttcgtttcggttttcgcgtttttttcgtgtggtaaggagtattaggttcggggatttcgaggggtttggggcgaagggtcgggattgggggtttttttaacggtttacggatttgcgagaggttcggttcgatggtcgtgaaagcgacgaattcgtttttgtgttggttttttggttttttttatttaaagttagttgtttttatggaagttcgtaatacgttatttttttttggtattttagatgtttaggtttttagtttagaatagatttagttttatagttagttttagatttaattttagttttgttacgttaaaaagtttttgcgagtgtgtgtgtgtgttttatggtattttttaaattaaaaggtgtatagttatttgattgtaaatataaggaatttaaaatgtttttagattttttatatgattttatgtagaggttaagatttatagtattagtaagtttatttatttagttttttaattttaatatttgttatgaagttatagttttttttatttaaataagtgtttattatatttaaataagtgttgtcgttttttgttattttatcgattgtaattgtattttagtataaatttagggtaagattggatgagtttggtttttttggatggttattaaggtaggttttgggaaatgtttttttgaggaaagaagaacgtttatttttaatgagttaattattagattattatgtttttttttttagttgtagaatattattgtttagtttttcgaataaatttatttattaataagtatttgagaatttattatgtggttaacgttaagtattgtggagttttttttggagaggaaattataattaaattggaagaggaaaataagttgggaagtagttgaaggtaaacgttatggtgtttttttggtttttgtatttttgtagtgtagtttttttagtttttttagtttttatagtttatttgtattttttgtttttttttgtatttcgttttgttgagacggagttttattttgttgtttaggttggagtgtagtggcgcgatttcggtttattgtaagttttgtttttcgagtttaagcgattttttttgttttagttttttaagtagttgggattataagcgcgttttataaatttttgtatttttagaagagacgggggttttattatgttggttaggttggtttcgaattgttgattttaagtgatttattcggttcggttttttaaagtgttgggattagtaggcgtgagttacggtgttcgggttatagttaaagtttttttttaagtttttgtgattgcggtaatagtaaacgttttataaatattttatatagaatgttttttaaaatattacgtaaggaatgataaaattatatgaatttttgatttatatttaagtaatatattgtgtaatatagattgggtgttttgaatgttgcgatagtggtcgagatttttattaggtgaagggagattttaattttcgcgtttaagaattaatattggatcgggcgcggtggtttacgtttataatattagtattttgggaggtcgaggcggacgtataatttgaggttaggagttcgagattagtttggttaatatggtgaaattttgtttattgaaaatataaaattagtcgggcgtggtggcgtatgtttgttaattttagttatttgggaggttgaggtaggagaatcgtttgagttcgggaagcggaggttgtagtgagttaagattacgtaattgtattttagtttgggtattcgagtgagattttgttttaaaataaaataaaaaattaatatttttgagtttatcggagttatattattgtgcgttaggggtagttattggttacgagtatttttttagggtagagattatatttttgtttttagtggggtcggggtgggcggaagtcggagagggattggaacgtcggttcggggaagtttcgcgcgtatcggggcgtattttgttttttagggagggaggttggggcggtaaggcgggcgcgggtggtttttgtttcgcgttagttcgttaggttacgtcgttggcgtttttttagcgttgggttatttgcgggtcggcgggttttcgcggcgaatagttgggtggtatggatacgtcgttcgagttttcgtagcgttaggtcgttagggttcgttttgttattcgttttattttgaggtaatttttttttcgttttttgattgcggaaggaagggtttgggaggaagtagaaaattttacgtggttcggggtgagggtcggtttttgttatcgtgagttggtttttaaaagattttttaagttttaagttttttttttttttttattttaaatttttttttttttagattttatgtttttaatataattataacggatttttcgtatttttacgtttttatagagatttagtatgttttttattgttttaaatgttaaagcggtaatagtaacgatgttgaggttcgtaaatgtgttttggggttataatttaaggtagtatttgttgaagattttttttaaatttgtttataattatttagagtgataaatttaaaatatattgtaagtaaaaattaatatgattttttttaggaagaaaaataaagattttagttatttatataggaataaggtaaataagaatagttttttgaggtatttaattgtgatttattaagtttttagtatagtttgattattttgttattagtttaatttaaagtagttttaaatagttatattttattatggtttgtacgtgaaaatgatttttaaatttttttatttgttgtagttatttttgaagaaaagatgatggttcggtgcggtggtttacgtttgtaattttagtattttgggaggtcgagttaggcggattatttgaggtaagagttcgagattagtttggttaatatggtgagattttcgtttttattaaagatataaaaattagttaggtttggtcggtgtgttattataattatagttatttgggaggttgagtcggagaattgtttgattcgggagaggaggttgattagttttaattatgaaaatttgtttttgggtattaaaaattattttataatttatatgttttttagtcgtttttttaatgtgttttggtttttttttttttttagtttggatttgtattatgtttttttgttttttttttttttttgacgatggtggagacggatcgntntttggtagtttaggttggagtatagtggtgtaatttcggtttattgtaattttcgtttttcgggtttaagtaatttttttgttttaattttttgagtagttgggattataggtacgtattattatgtttggttaatttttgtatttttagtagagatggggttttatcgtgttggttaggttggtttcgaatttttgattttagatgatttattcgtttcggttttataaagtgttgggattataggtgggaattattttatttagtttttttatttttttttttttttttttaaagaaaaggttttattttgtcgtttagtttatagtgtagtagtatgattatagtttattataatttttaatttttgggttcgagggattcgtttgttttagttttttaagtagttgggattataggtttatattattatatttagttatttgtttgattttttaaagtttgtttgggagtgaggggtttatttaggttttggtagaggtagggaatatttttaaatatcgttgttttgatgtttatttagtaaataaagaatgacgtttttatgtggtttaattagaagagttggttatatttataattaggattggtttaaagataagtaggggatggtaagggttgaaggaatttattgagaatagagatatgtttttgtttttttattatttaattattaatttatttttttttttagtaattatagtgtttattgattttagatttagataagaattattttatatgttttatatatattaattaatttaatttttatagttattataagggtaaatattgttaatatttttagtttataaatgagaaaagttatggtttggtgtagtggtttatatttgtaattttagtattttgggaggataaggtgggtggattatttaaggttaggcgtttaagattagtttggttaatatggtgaaattttatttttattaaaaatataaaaaaaaaaaaaaaaagtagggcgtggtggtaggtgtttgtaattttagttattcgagaggttgagtagg

SEQ ID NO: 39 - DNA, 6061 bp, Artificial Sequence
  chemically treated genomic DNA (Homo sapiens)
tggaattataggtgtttgttattatgtttagttaatttttgtatttttagtagagatggggttttattatattggttaggttggtttcgaatttttgattttatgatttgttcgttttggttttttatagtgttgggattataggcgtgagttattacgttttttgttttttttttttttttttgagatggagtttcgttttgtcgtttaggttggagtgtagtggcgcgatttcggtttattgtaagtttcgttttttaggtttacgttatttttttgttttagtttttcgagtagttgggattataggcgtttgttattatgttcggttaattttttgtatttttagtagagacggggttttattatgttagttaggatggttttgattttttgattttatgatttgttcgtttcggttttttaaagtgttgggattataggcgtgatttatcgcgttcggtttttttttttttttttttttttgagacggagtttttttttgttatttaggttggagtgtagtggtataattttagttcgttgtaatttttattttttaggtttaagcgattttcgtgttttagtttttcgagtagttgggattataggtacgtgttattatatttagttaatttttttgtatttttagtagagataaggtttcgttatgttggttaggatggttttaattttttgagtttatgattcgtttgtttttgttttttaaagtgttgggattataggtataaattatcgtgttcggttcgtttttttaaatttgaaatgtatttagataacggttgtaggatcgggttttttttcgattaaattattatttgagtcggatttggttgtatttttattagttttgtgaacgtgggtaaatgatttaatttatttgagtttttatttttttaggcgtaaaggaggttattcgaagtttagggtgtgggtaggttagttgaagtatttgatttaaaggatcgtgaggttaggttttagtaaacgtttaataaattgttaaaagatagtgttggtcgggcgcggtggtttacgtttgtaattttagcgttttaggaggttaaggcgggtagattacgaggttaggggtttaagattagttcggttaatatggtgaaatttttgtttttattaaaaatataaaaaaattattcgggtgtggtggtaggcgtttgtaattttagttaatcgggaggttgaggtaggtgaatcgtttgaatcgggtggcggaggttgtagtgagttgagatcgtattattgtattttagcgtggtaatagagcgagatttggttttaaaaaaaaaaaaaaaaaaaaaaaaaaaggtagtgtcgagaggtttgtattggcgattgtcggttagtaggggtcgttattgcggtttttgagtttttttggcgtcgtagtaggcgtatgcgtagcggagtttttttgtagaggtgaatttttttattggtttttattttaaaagatttagcgtatatttattattgtatttattatagttgatttggttgtggttgtttgtggtattttaggattttgttttttatggatgtggggatgatagtgggagagatttttttttgttaatatttggttttatttttgtagttatggggttgaaaattttttttttttttttaagttttttttttagttttttaaattatatgatgttagaattttttaataagtaatttatgtatttgagaagaaatttaattttttttttattaagtttcgggatatttgtgaatagtttttttttttttttttttttttttttttttgagatagagttttatttttagtcgtataggttggagtgtatgtagtgtcgtgatttcggtttattgtaatttttgtttttcgggtttaagcggtttttttgttttagtttttaaagtagttgggattttaggcgtttattattacgtcgggttaatttttttatttttagtaaagacggggtttttttatattgggtaggttggtttcgaatttttgattttaggtgatttgtttgtttcggttttttaaagtgttgggattataggcgtgatttatcgtaagtagtttaatttttttttaatttttaaaatttttaaaaatttttttgagacggaatttcgttttgtcgttaggttggagagtagtggcgcgatttcggttaattgtaattttcgtttttcgtttgatattttttttaatgaaaatttttttattatatttttgaaatgtttttattttgtacggaaaaaacggttgcgaagtttttaataggaaacgtaatacgtagtaggtgtttagtgtatttaaaaattttgaagaattttattattaataatgcgaaattgattatttttttgttaaaaatttatgttttaaatggcgtatgcgtttgatttgtaatttaattaaacgcgttataggtataggtgtaggtggttagggatttcgggcgtttttatttgttttttgtcgcgttttttgttttttagagttttaattttttcggaagatattttttagttttttattgggttaaatggtgataggaagagtaattattcgttaaatgaaatttaaggttgagatagcgttttgtaaagtaaagtgttcgaagtattcgtgagggggaggagtgtataggtttattttagagtttaggttggaatttgtattgttttttgtggatttatattttttttttttttagtttaggaaaagtattgtagtggtttttttgttttataaagtgagtttaaggaaagatgtatcgtagggggtttatttgtattgtgagaatattatttatgtaagaaatgttgagtatttattatgtgttaaatagcgggttgggttttttataagggatagagttatataattgaatgttaatttatgagatatgaaatatatttaattgttttttagggttagattaggatataaatgttaaatagtttttttgcgtttttttttggagaggaaatgaaatagaaaatgaaattgtgttagtaaatcgtttagtcgggtgtttgggatatggtaaattagttttgaaataaataattgttttattaatagtaattttagttaattaaaatagatagcgtttattgagcgttgggtattaggtacggttttaatttttttagatgtttttagttcgttttatttttttttaaataatagggtggtattgattattttcgagtaggtgaaattgaggtatagagaaattttagtagttggtagaagaatacgtagtgtggttaagttagtaaggtgtttggtttattgttatatttataaaatttttaataatgtttggtgtatagatgtttagtatgtatttgtgggattagtgatttcgatgtttgttttttataaagtttttatttagaaataattataggtaaggagttgtaaaaatagtatagtggtcgcgagtgttttttttttttcggttttttttaggggtatcgttttacgtaataatgtttaaatagggaaattgatttgggtataatttatagattttatttattttgtaaattggttttaatagaagtattggataatttgtaagttaatatcgttgttatggttttcgtttttagttaaaacggcgttttttattttgtgtatttgaatattgtatatcgagggcgattatcgttttcgagatgtttagtttttattttagagcgtcgcgtcggcgtcgaatgggttaacgggcggggggatacgttttcgtgcgtttgcgcggcgttttttcgtttcgttttcgtagcgtagttatatgattcgtttaatcggcgttcgtttataaaaagttgagtgttgacgttagcgttttttttcgtcgtcgtcgtcgttattttcggcgcgattcgtttttttcggttttatttgggagaatttatcgttattcgttattatggtgagtaattttgtttcgttggtgtttcggagcggcggcggggttttcgcggggtttacgttgtttagtttgggacgttggggtttttcgtgttaggaggagacgtagcggcggcggggtcggaggattcggggttggggaagcggtcgtcgttatgtttgtgcgtcgcgttgtttatcgagtttttttttcgttttcgagggcgttataattttgtttagatttggttggagttgggttgttagcggggatgggggtggggaatgatgatgtggtaggcgtagtaatggcgggtatcgcggtggaagcggggagatagggaggcgttttatgtaattcgcgggtcgcgagtttgagatcgattttttgtcgggggattaggggcggtagggaatggtagaacgagtaaagcgatatttgaaaggttttttttttttttttaaatatttttttttgatgttgttaatcgtcgattttaggtatttgttttttttatgatttttagatgtataaagatttttattgagatacgaggtgtaggtttgtggtagttagggtcgtttcggtttttcgttattttttggggtgggtggttttgtttgatttcgtttgttaaggggtgattttgtattttatgatgaagttttttgttcggggaagtttgggtggttcggtgataacgtggagggggttttaggagaggatttattttttacgtgtttggttttaaatgagattttagtatttgtatttggtattaaggaaatttgttgatatttagttttatttttgagtatttttatttttgggttgttaattatgaatgatatttattaacggtggttttttggagattgcggggtggtttttaaggggtgttaggttggtaagattcggtgggtttggggtattttagtattaatttttttttggttttgggtatgttggttcgtttggattgaacgtttcgtgttatgttgtgtttttggaaattacgagttggtttgagtttttttgttttgtttaggtgaattttacggtagattagattcgcgttattatggataagaaggttaatattcgtaatatgtttgttatcgtttacgtggattatggtaagtttacgttgatagattttttggtgtgtaaggcgggtattatcgtttcggttcgggtcggggagatacgttttattgatattcggaaggacgagtaggagcgttgtattattattaagttaacgtgagttttttgtgttttttgtatttaggtagggaggtgttggtttggtagttggaggttattgggttagggtgcgcggggagagatttggtaacgttttttttttttggttttttaatttatgggagaatgagtgaggtttagtttagcgagataggatggagaggtatagggattcggggtattgcgagttggaaggtttttttgaggagggggtttaatttcgtggttttttttttttgggggatttgtttttatttttataatatttggagaggtttggttgttatatttgggaggggagggtgttttagtgtttgggacgttgggaagtttttgtgttgtattggatgatgtttattttatgttagtttttggtttcgatatgagtagggggagcgtagagtacggtgattttaattgttttttgttttgggttggtatattggtgagggattttggttaaggttttttattttttttggagtaggggtagaagtgaggaggggagggtcggagtttttggaggtttttgtcgttttgttgggttttttagttgttattttgagttaggtgtgatgaattttgggattaagtcggtggggtaggatgtttggttaggagggttttgaggatttggttatggggttggtattaggagttttttgttatgggggtggtatgtttcggatagaggtaaaggataagggtgggttggtttttgtgggagtttttttagggatgagttatggagggaggagtagtttggtttttgatagtattttagattttttgggttaggtgtgtggtttttgtttttttgacgagtttttttttttattagt

SEQ ID NO: 40 - DNA, 6061 bp, Artificial Sequence
  chemically treated genomic DNA (Homo sapiens)
attgatggagggagggattcgttagggggataggagttatatatttggtttagggagtttgggatgttgttagaagttaggttgtttttttttttatgatttatttttggagaggtttttataagagttaatttatttttgttttttgtttttgttcgagatatgttatttttatgatagggaatttttggtattagttttatagttagatttttagagtttttttgattagatattttgttttatcgatttggttttaagatttattatatttgatttaaagtagtaattaaaagatttagtaggacggtaaaagtttttagagatttcgatttttttttttttatttttgtttttgttttaggggaaatgaagagttttagttagagttttttattaatgtattaatttaggataaaaagtagttggggttatcgtattttgcgttttttttatttatatcggggttagaaattgatatggaatgaatattatttagtgtaatataggagttttttagcgttttaagtattagaatattttttttttttaggtgtgatagttaaatttttttagatattgtaggagtgggggtaagttttttagggagggagaattacggagttaagttttttttttaagaaaattttttagttcgtagtatttcgaatttttgtgtttttttattttgtttcgttggattgaattttatttatttttttatgaattaagaaattaggggaaagagacgttgttaagttttttttcgcgtattttggtttagtggtttttagttgttaggttagtatttttttgtttgggtatagagggtatagggagtttacgttgatttgatggtgatgtaacgtttttgttcgttttttcgggtattagtgaagcgtgttttttcggttcgggtcgaggcgatgatgttcgttttgtatattagggagtttgttagcgtggatttgttatggtttacgtgggcgatgatagatatgttgcggatgttggtttttttgtttatgatggcgcggatttggtttatcgtgaagtttatttgggtaagataaggaggtttagattagttcgtgatttttaggaatatagtatggtacggagcgtttagtttaaacgaattagtatgtttaaggttaggagggggttggtgttggggtgttttaagtttatcgaattttgttagtttaatattttttaagagttatttcgtaatttttaaggaattatcgttaataggtgttatttatgattgataatttagaaataaaagtgtttaggaataaaattgagtgttaatagatttttttgatattaggtataaatattaaagttttatttggggttaaatacgtaagggatgaatttttttttaaagttttttttacgttgttatcgggttatttaaattttttcgagtaagaagttttattataaaatgtaaggttattttttggtaaacgggattagataaggttatttattttaggaaataacggggagtcggaacggttttaattgttataagtttatatttcgtgttttaataagagtttttgtatatttgggagttataggaaggataagtgtttaaggtcgacgattaatagtattaggagaaggtatttggaaggaaaaggggagttttttaggtgtcgttttgttcgttttgttattttttgtcgtttttagtttttcggtagaaaatcgattttaaattcgcggttcgcgggttatataaggcgtttttttgttttttcgtttttatcgcggtgttcgttattattacgtttgttatattattattttttatttttattttcgttaataatttagttttaattaggtttgggtaaggttatggcgttttcggaaacggagaaagggttcggtgaatagcgcggcgtatagatatggcggcggtcgtttttttagtttcgggtttttcggtttcgtcgtcgttacgtttttttttggtacggggggttttagcgttttaggttaggtagcgtaggtttcgcggaggtttcgtcgtcgtttcggggtattagcgaggtagggttatttattatggtggcggatggcggtggatttttttaggtagaatcgaaagaagcgagtcgcgtcgaggatggcggcgacgacggcggaagagaacgttgacgttaatatttagttttttataggcggacgtcggttgggcgggttatgtgattgcgttgcgaaggcggggcgaagggacgtcgcgtaagcgtacggaggcgtgttttttcgttcgttaatttattcggcgtcggcgcggcgttttagaatagaagttgggtatttcgggggcggtggtcgttttcggtgtgtagtgtttaggtgtataaagtaaagagcgtcgttttagttgagaacgagaattatagtaacgatattagtttataagttgtttagtatttttattaaaattaatttataaggtgaatagagtttgtggattatatttaagttaatttttttgtttggatattgttacgtaagacgatatttttgggagaagtcgagggaaaaaggatattcgcgattattatattgtttttgtaattttttatttgtaattatttttaaataaaaattttataagaagtaggtatcggaattattgattttataaatgtatattgagtatttatatattaggtattgttaggggttttgtagatatagtagtggattaaatattttgttagtttgattatattgcgtgtttttttattagttattaggatttttttgtgttttaattttatttgttcggaggtgattaatattattttattgtttgggggagagtgaaacgaattaaagatatttaaaagaattaggatcgtgtttgatatttaacgtttaataaacgttatttattttaattagttaagattgttattaataaaatagttatttattttaggattggtttgttatgttttaggtattcggttaagcggtttattggtataattttattttttattttattttttttttagggggaggcgtaggaagattgtttagtatttgtgttttaatttgattttaagaaatagttgaatgtattttatattttatgaattggtatttaattgtgtaattttattttttatgaaaagtttaattcgttgtttagtatatagtaggtatttagtattttttgtatgaatgatgtttttatagtgtaaatgaattttttgcggtatatttttttttaaatttattttgtgaaataggagagttattgtagtgttttttttgggttgggagagggggaggtgtggatttataaaaagtaatgtaaattttagtttggattttaaaataaatttgtatattttttttttttacgaatgtttcgggtattttgttttataaagcgttgttttaattttgggttttatttaacggatgattgttttttttattattatttaatttagtggaaaattgaaaagtatttttcgaaaggattgaggttttgaaaggtagagggcgcggtagggagtagatgggagcgttcggggtttttaattatttatatttgtatttgtgacgcgtttagttaagttgtaagttaagcgtatgcgttatttggggtatgagtttttagtagaggggtagttagtttcgtattattaataataaaattttttaaaatttttaaatgtattgagtatttgttacgtgttgcgttttttattgggggtttcgtagtcgtttttttcgtgtaaagtgggagtattttagagatgtaatggaaaggtttttattaaaagaggtgttaggcgagaggcggaggttgtagttagtcgagatcgcgttattgttttttagtttggcgatagagcgagatttcgttttaaaaaaatttttaaaaattttaaaaattaaagaggggttaggttgtttgcggtggattacgtttgtaattttagtattttgggaggtcgaggtaggtaaattatttgaagttaggagttcgagattagtttatttaatatggagaaatttcgtttttattaaaaataaaaaaattagttcggcgtggtagtgaacgtttgaaattttagttattttggaggttgaggtaggagaatcgtttgaattcgagaggtagaggttgtagtgagtcgagattacggtattgtatgtattttagtttgtgcgattgagagtaagattttgttttaaaaaaaaaaaaaaaaaaaaaggagggggggttgtttataggtatttcggaatttaataaaagaggggttgaatttttttttaagtgtatgggttgtttattgaaaaattttaatattatgtaatttaaagaattagggggagagtttaagggaaaaaggggaatttttaattttataattgtagggatggagttaggtgttggtagggaaggattttttttattgttatttttatatttatgaagagtagaattttggagtattataagtagttataattaggttagttgtaataagtataataataaatatacgttgggttttttagggtggggattaataaaaaaatttatttttgtagagaagtttcgttgcgtatgcgtttgttgcggcgttaggagagtttagagatcgtagtagcggtttttgttgatcgatagtcgttagtgtaggtttttcgatattgtttttttttttttttttttttttttttttaagattaagtttcgttttgttgttacgttggagtgtagtggtgcggttttagtttattgtagttttcgttattcgatttaagcgatttatttgttttagtttttcgattagttgggattataggcgtttgttattatattcgggtaatttttttgtgtttttagtagagataggggttttattatgttggtcgggttggttttgaatttttgatttcgtgatttgttcgttttggttttttaaagcgttgggattataggcgtgagttatcgcgttcggttaatattgttttttaatagtttattgagcgtttattaggatttgattttacggttttttaaattaaatattttagttaatttatttatattttgggtttcgggtggttttttttacgtttgagaaaatggagatttagataagttaagttatttgtttacgtttatagagttagtaaaggtgtagttaaattcgatttaagtagtggtttaatcgggaaggagttcggttttgtaatcgttgtttagatgtattttagatttgggaaaacgggtcgggtacggtggtttatgtttgtaattttagtattttgggaggtagaggtaggcggattatgagtttaggagattgagattattttggttaatatggcgaaattttgtttttattaaaaatataaaaaaattagttgggtgtggtggtacgtgtttgtaattttagttattcgggaggttgaggtacgagaatcgtttgaatttaggaggtggaggttgtagcgagttgagattgtgttattgtattttagtttgggtgatagagagagatttcgttttaaaaaaaaaaaaaaaaaaaaaggtcgggcgcggtgggttacgtttgtaattttagtattttgggaggtcgaggcgggtagattatggggttaggagattaagattattttggttaatatggtgaaatttcgtttttattaaaaatataaaaaattaatcgggtatggtggtaggcgtttgtagttttagttattcgggaggttgaggtaggagaatggcgtgaatttgggaggcggagtttgtagtgagtcgagatcgcgttattgtattttagtttgggcgatagagcgagattttattttaaaaaaaaaaaaaaaaaataaaaaacgtggtggtttacgtttgtaattttagtattatgggaggttaaggcgggtagattatgaggttaggagttcgagattagtttggttaatatgatgaaattttatttttattaaaaatataaaaattagttgggtatggtggtagatatttgtagtttta

SEQ ID NO: 41 - DNA, 6167 bp, Artificial Sequence
  chemically treated genomic DNA (Homo sapiens)
tattatgatttgaaattattttttttatttgtataattgtttatttttgtttattttattaaatggtattttttatgagagtaaagttttattgtagaatttttaagatttagtattgtatttaatatatatagtgggtaataaatttttttaaaagaatgaatgttttatttaattttattttttgttattttttaagaggaaatttttttattttagtttatttcgtttttttttagttttattttttttagatagattatatatgggcgtttttggttaatttatttttaagtttggtttgaaatagttttttatttttttattataaagtttgggtttttttacgtttttttttttttaaaatttttttattgtttttgatcgttttttagttttttggaatttttttttttttttattttttatgttttttagtgttattgagttttgttggttaatagggttgttttttttttattttttatttttttgtaatatagaatttaggtttttttttatttagttgtaagatttttagaggtaaaggtttatgttatggattttatttttaaattttgattgtagttagtttttagggaagtttttattgttgttgataatgggtgtttaattggttaggttgtgagtgagagaaattaattgaggatgttttattttatttaataaaaaaggaatttattggtttgtataattaaaaagtttaggttgagtttagggattttttgtacgtttgttttttttttttgtatgttttttttttttgattttttttgtattggttttatttttaggtaggttttttaggtttgtgggcgaaacggtttttaggtttatattttattggtttagtattattagggaaagggaattttttttttttaagagttttggaaaaagtgatttttattggtttggtttgggttatgtgtttattttgatttaattattatagttagggaaatgaattatttttaggttaggttatttttgggtggatggttaggtttagggaatatatttatttatagatgtagagtaggggttatttgtttttaattatatggattagggtggttttttaaaggaaattgttggttggggaatagtaataaaaagaaaggggaattgatgttggttatgtaaaataaaagatgtagacgtagattatgagaattttttatgttgagttttagtaagaatttgataaatacgttaggtgagttgtataggataattatcggggaattggtttgttttggttggggtagaggatgtttttttttagtttgggcggttttttagtgatagtataagaattttaggtcgatattttggtttagtgttgttattcgtaagttcgggaagattgtgatgtagttggtttagggtaaaagttgttttttttagatttttataggcgattttgttgtatagttaaggttgaaaaatgttgttttagtaaacgttttattgtagtaagatgggtttagattaatttttagggattacgttttttgtgataggattggtatgtttttttttatttgtatagttttttagaaaagggttattggagtttttttggaggttgaggatgggtgggtgaattgtggatgattttatggatttaaagtttttgaaaagaataatagttattgtttgttgaatgttaattgtaaggtaggtattgtgtgttgggatttgatatatggtagttcgtataagttttagtttttataataatatttttatgtgggtattattattattatttatttatttgagatagagtttcgttttgtcgtttaggtttgagtgtagtgttgtgatttcggtttattgtaagttttatttttcgggtttacgttatttttttgttttagttttcggagtagttgggattataggtggttattattacgttcggttaatttttttgtatttttagtagagatggggttttatcgtgttagttaggatggtttcgattttttgattttatgattcgtttgtttcggttttttaaagtgttgggattataggtatgagttattgtgttcggttttatgtgggtattattaatattagttttattttatagttgaagaaagtgagatataaaaagtatggttggttgggtacggtggtttacgtttgtaatattagtattttgggaggttaaggtaggtggattatttgagattaggagtttaagattaggttagttaatatggtgaaatttggtttttattaaaaatataaaaattagttaggtgtggtggggtgtatttgtggttttagttattagggaggttgaggtaggaaaatagtttgaatttaggaggcggaggtcgtagtgagttaaaattgttttattgtattttagtttgggtgatatagggagattttgttttaaaaaaagtaaaaataaataagtaaataaaaagtttggttggttgggtgttgtggtttatatttggaattttagtattttgggaggtcgaagtgggtgaatcgtttgagtttaagagtttaagattagtttgggtaatatagcgaaatttttttttacgaaaatataaaaaaaaaaaaaaaaaaaaaaaaagtaaaagttaggcgtggtggtaggtatttgtagtttaagttattcgagaggaggaggttggaggattatttgagtttgggaggcggaggttgtagtgagttcgcgttattgtattttaatttgggtgttagcgtgagatttcgttttagaaagaataaaaatattaaaaaaaaaatttggttaaggtattttattagggagtggtaaaatggatatttagatataaggttatttgcgttgtaatagtttggtttttttgtttttgcggtaggagttttttgagaggcgtattatttttgttttaatggataattcggtagatagtgggagtgagttttttatttttttagcggatttgagacggtaggtttcgagacgagggagttttggtttattaagttggtttttataagaaaatatgtttggaggggggatagttatagagggattaagtttaagaaagttatatttttatttatttaatttttttgatttcgatttttagaggttgttggggtttatagaggtttttatttttttttttttttttcggtgtcgttaagtattttttttttttatattttttttttgttttttttttaaatttagaaaaaatagtattttttttggatttagagttagagtaggaggagtttttttttttcggaatttttgttttttttggggtgagtaattgattgcgtcgtgggggcggggagggtttttttgttcgcgttcggttttagggagatttgcgggaatcgttttttttcgttattatttattttttgtttttttttttttttcgttttggttaggttcggggtgaggagtgttatttcggagtttgggcgtttcggtagtgacggttttttagggattgtagggggagttcgggttgtagcgtttgtttagttcgtgtttattgcgtcgaaggttttttcggtttggtttcgcgtttagcgtcgtattcgggaggaggagcgaggaggcggcggaagagttcgcgcggtcggagttcggggttgggagtggagagggaatttttagggggtagtatcgagtcgttaagtcggtttttttttcgcgtttagttcggggtttttagatagtttatagggaagtttttttttcggattttcgtagtgtgggtcggttttttatttggattggataaaggggggaaagtgattttttattataaggattattattttttggtgagaataagaattaggttttttttggggtaattagtttttttatttcggttttttaaaggtgggttttttgtcggcggggattagggaatagtttttcggtttcgggggagtataggggattttaggtattagtagttttattttatcgataggtggtagaggtaaggtagtttattgttatatagtgttttaagaattaagtggtcgtgattttttatttttaattttttagcgatattcggaaagatatcgtgttatagatcgaggttcggggttaaggttaaggtttcgttttttttgggcggtttttgtttaggcgggtttagtcgtttttttttcgtattttcggttcgtttttacggtttttgaggtgggcgggcgggttttggatgatagcgatagaatttcggttcgattcgttttcgttttcgttttgggtttgggtttttttagtttagtttacgtttaggagtcgtttgagtagtcgcgcgtttagcgttatacgttacgagtttttttcgtttgggcgttttcggatttcgcgagcgttcgggttttcggtttggaattagggaggagggagggagcgagggagtaattagttgcgattcggaaatgttatataaggagtaggaaggatttttcgtcggaataatttttatttgggtagtattttatttggagtggttcgatatggttcggtcgttttcggttttgggaggagggaagaaggcggagggaggggtaacgcgggaatttcggagttgcgcgggtttcggaggtttcggcggcggttagagttttaggttttttcgaagtttgggcgtttgggatgcgggcgcgggcgcgggttttagggtgtaggatggaggtgtcgggcgttgtcggatggggggttttacgttatttcgggttttttcggtcggttttgttatattagggttttttgttttttatatatggttatgtacgttacgacggaggcggattcgtgtcgttttagattttttaaatagaggcggattcggggagtcgcgagagattttagcgcgtagaatttggggagtcgtcgtcgttattcgtcgtcgtagttagttttcgtcgtcgtaggatcggtttttgttttagttttcgtagtcgcggcgcgtttacgttcgttcgcgtttagggcgagtcggggtcgtcgtttgtacgttttttagtgtttttcgcgtttcgtatgtaattcggttaggttttcgtaattgtgttttttgtagttttagtttcgggttgtattttttcgtttcgatattagttttttagtttgttcgtttaggatggtcgcggttaaggtcgagatgtagttgatgttttcgttgtagatttttgattcgttcggattttttttttattcgtttattatggataattattttaagttggaggagatgatgttgttgagtaacggggttttttagtttttcggcgtcgtcggggttttagagggtagcggtagtaatagtagtagtagtagtagcgggggcggtggaggcggcgggggcggtagtaatagtagtagtagtagtagtatttttaatttttaggcggatacgggcgagtagttttacgagtatttgatcgtaggtaagtagtggtttacgtcgagggggaattttttcgttattattttggcgttttgttttttatcgtaggagtgtttttggattttagaatgagagtcgggttttttttttatttttcgtatttttagagttatgtgttagagggatgttaaggaattttatatagtttattttttgtttttatttttagcggagcgtagaggatcgagtttttgttttggatggagagttttggagttgcgtgggtgggtggagggggagggtttgttttgatgagcggggttgcgttttttatttttagtaagatttgttttgttttgtttgtcgtttgtttttaaggaaggatcgtgatttttggtcgtggatgtttcggtagttcgggtttgggggcgcgtattagtcgcggttatgggggtgttggcgggaatttttcgttcgtatagtcgtcgttgcggagcgttgcgagttgtagtggagggggatttttcgtatttgcgttagttgttgttgaaatgggttttgttattggtgcgggtttaggaatattgtaatgtgttgttattaattattaattatttcgggagttaatggtagtcggttcggttttttgtttggtagttcgggtcgttttcgttttttagtgattgttttttagtaattaggtttttcgttttttttttttttgttaga

SEQ ID NO: 42 - DNA, 6167 bp, Artificial Sequence
  chemically treated genomic DNA (Homo sapiens)
tttggtaggagagagagaagcgggaggtttggttattggaaagtaattattggaggacgaggacgattcgagttgttaggtaagagatcgggtcggttattattgattttcgaggtagttaataattgatagtagtatattgtaatgtttttggattcgtattagtggtagagtttattttaataatagttgacgtaaatacggagaatttttttttattgtagttcgtagcgtttcgtagcggcggttgtgcgggcgagggattttcgttagtatttttatggtcgcggttagtgcgcgtttttaaattcgggttgtcgggatatttacggttaaggattacggtttttttttggggataggcggtaagtaaggtaaggtaagttttattggaggtggggggcgtagtttcgtttattaaaataagttttttttttttatttatttacgtagttttagagttttttatttaaaataaaagttcggttttttgcgtttcgttagggatgagggtagggggtgggttgtgtggggttttttggtatttttttaatatatgattttggggatgcgaggaatgaaagggaaattcggtttttattttaagatttaggagtatttttgcggtgaaggataggacgttaggatggtggcgaaagggttttttttcggcgtaggttattgtttatttgcggttaggtgttcgtagggttgttcgttcgtgttcgtttgagggttgaaggtgttgttgttgttgttgttgttgttgtcgttttcgtcgtttttatcgttttcgttgttgttgttgttgttgttgttgtcgttgttttttggggtttcggcggcgtcgaggaattggggagtttcgttgtttagtagtattattttttttagtttagggtagttgtttatggtgggcgagtgaggaaaggattcgaacgggttagagatttgtagcggggatattagttgtatttcggttttggtcgcggttattttggacgagtaggttggagagttggtgtcggggcggggggatgtagttcggggttggagttgtaggggatatagttgcgggggtttggtcgggttatatgcggggcgcggggaatattgagaagcgtgtaggcggcgatttcgattcgttttgggcgcgggcgggcgtggacgcgtcgcggttgcggaggttggggtaggggtcggttttgcggcggcggaagttggttgcggcggcggatggcggcggcggttttttaagttttgcgcgttgggatttttcgcgatttttcggattcgtttttatttgaagggtttggaacggtacgggttcgttttcgtcgtgacgtatatggttatatatgggaagtaggaagttttaatatggtaggatcggtcgggaggattcggagtgacgtgaagttttttattcgatagcgttcggtatttttattttgtattttagggttcgcgttcgcgttcgtattttaggcgtttaggtttcggggaagtttagagttttagtcgtcgtcggggttttcgggattcgcgtagtttcggagttttcgcgttgttttttttttcgtttttttttttttttttagagtcggaagcggtcgggttatatcgggttattttaaataaggtgttgtttaaataagggttgtttcggcgggggattttttttgttttttatatggtattttcgggtcgtagttggttgttttttcgtttttttttttttttttggttttaagtcgggagttcgagcgttcgcgggattcggggacgtttaggcggggagggttcgtggcgtgtggcgttgggcgcgcggttgtttaggcggtttttaggcgtgaattaggttggggaagtttagatttagagcgggggcgagggcgagtcgggtcggggttttatcgttgttatttagggttcgttcgtttattttagggatcgtgagagcgaatcgggagtgcgggggaggagcggttgggttcgtttgggtaggggtcgtttaggagaggcggggttttgattttgatttcgggtttcgatttatggtacggtgttttttcgggtgtcgttgggaaattgaggataggaagttacggttatttggtttttgggatattgtatagtagtgagttgttttgtttttgttatttgtcggtgggatggggttgttggtgtttggggttttttgtgttttttcggaatcgaaaggttgttttttagttttcgtcggtaaagagtttatttttgggggatcgaagtggggaagttgattgttttaagagaggtttgatttttgtttttattaggagataatggtttttgtggtgaggggttatttttttttttttatttagtttaggtggagggtcggtttatattgcgggaattcgaaagaggggtttttttatgggttatttggggatttcgggttgggcgcgaagagaggatcggtttggcggttcggtgttgttttttggaggttttttttttatttttagtttcggatttcggtcgcgcgggttttttcgtcgttttttcgttttttttttcggatgcggcgttgggcgcggagttaggtcgggggagttttcgacgtagtgagtacgaattgagtaggcgttgtagttcgggttttttttgtagtttttggggagtcgttattgtcgaggcgtttagatttcgggataatattttttatttcgagtttggttaaggcgagggggagaaggaagtagggggtgggtggtggcgagggagaacgattttcgtaggtttttttggggtcgaacgcgaatagggaagtttttttcgtttttacgacgtagttagttgtttattttaaagggaatagggatttcgggaagggaaggttttttttgttttagttttgaatttagaggaggtgttgttttttttggatttaaaaagaaagtagaaagagaatgtggggaaggagggtgtttgacgatatcgagagggaagggaggaggtgagggtttttgtgaattttaatagtttttggaggtcggggttagggggattaggtgggtgagggtgtaatttttttggatttaatttttttgtggttgttttttttttaaatatgtttttttataaaaattaatttaatgaattaggattttttcgtttcggagtttgtcgttttaagttcgttggggaggtggggggtttatttttattgtttatcgagttgtttattggggtaggagtgatgcgttttttagaggatttttgtcgtaagggtaggaaggttaggttgttgtagcgtagatggttttgtgtttgaatgtttattttgttattttttggtagggtattttagttaaattttttttttaatgtttttattttttttgagacggggttttacgttggtatttaggttggagtgtagtggcgcgagtttattgtaattttcgttttttaggtttaagtgattttttagtttttttttttcgagtagtttggattataggtgtttgttattacgtttggtttttattttttttttttttttttttttttttgtattttcgtagagaggggtttcgttgtgttgtttaggttggttttgaatttttgagtttaagcgatttatttatttcggttttttaaagtgttgggattttaggtgtgagttatagtatttagttagttaagttttttgtttatttgtttgtttttgttttttttaagatagagtttttttgtgttatttaggttggagtgtaatggggtaattttggtttattgcgattttcgttttttgggtttaagttatttttttgttttagtttttttagtagttgggattataggtgtattttattatatttggttaatttttgtatttttagtagagattaggttttattatgttggttagtttgattttgaatttttgattttaggtgatttatttgttttggttttttaaagtgttggtattataggcgtgagttatcgtgtttagttagttatgttttttgtgttttattttttttaattgtaaaatggggttaatgttaataatatttatatggggtcgggtatagtggtttatgtttgtaattttagtattttgggaggtcgaggtaggcggattatgagattaggagatcgagattattttggttaatacggtgaaattttatttttattaaaaatataaaaaaattagtcgggcgtggtggtggttatttgtagttttagttatttcggaggttgaggtaggagagtggcgtgaattcgggaggtggagtttgtagtgagtcgagattataatattgtatttaagtttgggcgatagagcgagattttgttttaaataaataaataatagtaataatatttatatgggagtattgttgtgaggattgaaatttatgcgggttgttatatgttaagttttaatatatagtatttgttttgtaattggtatttaataaatagtggttattgttttttttagaggttttggatttatagagttatttatagtttatttatttatttttagtttttaagaaaattttagtgatttttttttggaaagttgtgtagatggggaaaaatatattaattttattataggggacgtaatttttaagagttgatttgaatttattttgttgtagtagagcgtttattagagtagtattttttaattttgattgtgtagtagaatcgtttgtggaagtttgaaaaagatagtttttattttggattagttgtattataattttttcgagtttgcgagtggtagtattgagttaaggtatcggtttgggatttttgtgttgttattggagagtcgtttagattgggagagaatattttttgttttagttagggtaaattagtttttcgatgattattttgtgtaatttatttaacgtatttgttaggtttttgttgaagtttagtatgggaaatttttatagtttacgtttatattttttgttttgtatgattaatattaatttttttttttttttattattattttttagttagtagttttttttggggagttattttaatttatgtggttgggggtagatagtttttattttatatttataagtaggtatgttttttgggtttggttatttatttaggggtggtttagtttaggagtggtttatttttttagttgtagtgattgagttaggatgggtatatgatttaaattaggttaatgagaattattttttttagaatttttgggaaagggaaattttttttttttgatggtattaagttaataggatgtaagtttggaggtcgtttcgtttataggtttggagagtttgtttgagaatgaagttaatgtaggggaagttagagagaagagatatatagaagagagagataaacgtatagaaggtttttggatttagtttgagttttttagttatgtaggttaatgaattttttttttattgaataaaataaaatatttttagttagttttttttatttataatttaattagttgaatatttattattaataataataaaaatttttttgaggattaattgtagttaaggtttgggaataagatttatggtataggtttttgtttttaaggattttatagttgggtagaagagagtttggattttatgttataagagaataaagaatagaaaggaagtagttttgttagttagtaaaatttagtgatattaagggatataggagataagagaagggagagattttaggaggttgggagacggttagggataatgaagagattttggaggagaaggaacgtgagaaggtttaaattttgtggtggggaagtgagaagttgttttaggttaggtttgggggtgggttggttaggagcgtttatgtgtggtttgtttggggaaaatgaggttggaaggggacgaaatgggttagagtagagagatttttttttgggaagtagtagaaggtaaagttaaataaaatatttatttttttgaaaaggtttattgtttattgtgtgtattgggtgtagtgttgagttttagagattttgtagtgaggttttgtttttatggaaaatattatttagtgggatagatagaaataaatagttatgtaaataaaaaggataattttagattatggtg

SEQ ID NO: 43 - DNA, 6025 bp, Artificial Sequence
  chemically treated genomic DNA (Homo sapiens)
gtttaaaaattgttattttatttataggtaatgtttaaaatgtttgtaataagatgttatgtggaaaaaaatgtagaatttaaaattgtttgtgtaggttgggggtgatttatatatataattttagagttttaggaggttaaagttagaggattatttgagtttaggagttcgagattagtttgggtaatataataagattttttttttataaaaaataaaaaaatgagttgggtatggtggtatatgtttgtagttttagttatcgtttaggaggttgaggtgggaggatcgtttgagttttagagttagaggttgtagtaagttaggattgtgttattgtattttagtttagtagtataggaatattttgtttttaaataaataaataaaaattttttgtattttataattgtaaaagtataaaatgttggtatacggatatattagaatagtagaagaggttttttttaaaaaattttttttttttttttttttttgatttttttttaaaaattaaggtgtttttttagttagtaggtagtgttttagttttataaaaattattaaggagagagtaaataaaaaattaattagaataataaaataattttttaaattttaattttgttttaattttttaatatttaaaattttttggttatgtttgcgtatattttatgtttttaagtaatgttttgagtaggtaatgggaattggtgttttttaaattgtaaaattaaaataagggtttatagtggtttaggtttgtaattttagtattttggtaggtcgaggcgggtagattacgaagttaggagttcgagattaggttggttatttttattaaaaatataaaagttagttaggtgtggtggtacgtatttgtagttttagttatttgggaggttgaggtaggaggatcgtttgaatttaggaagtagaggttgtagtgagttaagatttgggtaatagagtgagattgtatttcgggaaaaaaaaattatatttgagttttttttaaatatttgatagtaatttatttataaattattaatgagttaatattttagtagtagggttaattaataattaattaaataatgtttaatagtaagtttagagttagggttatgaagtggtttaaagaaaattaaagtagagtgaggggataaagagtaatggaaatagtaatttagatagggtggttaaggaagtttttttttaggagattatattggaatagaggtttggatgaaatgagggaaggaagtatatgattcgtttatttattatgtgaatgtgtgttggttatggtgtttgttaattgtatttttttggtttttagttatatttttttatatgggtattgaattatttatatttttatgatttagtacgttaattagattttatagtcggggaaggaagtgtttgtattttttgtgttttttaaatattttttattggttatatagtttttattattaatttagtatttgttggatggtttttggttagttttgtaaatgaatttggaattataagttttttgaagagtaataaagaataatagagaataaatagagaaataaaatataaaattttagttttatatatttaggattggtaaaaataaaataaaataattatatatatatatatataaaaatttaatcgttaaatttttgaaatggtagaattttaaataggtaaagatatattaatggttataaaatatatataataaagtatatataaaaatggagatttttttgaaattttgtgtttgaaaattataaagaaaaattgttgaaaattatgtaaaaaatggaaagaaattaaattataaagaatagagtatttataagtattgtaaaagtatgagttttggttgataagagggagttttttttttttttttttttttgagattgagggggggtagtggcgcgatgttcgtttattgaaagttttattttttgggtttattttttttttttgttttagtttgtcgcgtagttgggattataggtatttattattatgtttagttaatttttgtatttttagtagagacggggttttatcgtgttagttaggatagtttcgattttttgatttcgtgatttgttcgttcggttttttaaagtgttgggattataggtatgagttattacgttcggttcgagttttttgattaatagaaaatttaataaaaatggaaattgttgtttaaaaaaagttttaagaatattattggtttttagttttataggtatttttttgttaattttattgattttttgttgttatataatagttttatgaaaataggatatttggttaggaatggtggtttatgtttgtaattttagtattttgggaggtttaggtagggggatcgtttgagttttaggagtttgagattagtttggggaatatagtagacgtttttgtttttgtaaaatataaaaaaattagtttagtggtggtttatgtttgtagttttagttatttgggaagttaaggtgggaggattttttgaatttagaaggttaaggttgtagtgagttataattatgttattgtattttagtttgggtaatagagtaatattttgaaaagataaaaagaaaggaaggaaggaaggaaggaaggaaggaaggaaggaagagagagagagagagagaatgggaggggaggggagggaggggaggggaggataggggaggggaggggaagagaagggaagggaagggaggggaagggtagggaagggagaggaagggtggggaagggtggggaaggggaaaataggatatttatgttgtttttttttttttaaagaaggtaatttgatattatttttaattagtagaaaataataacgcggttaatagaattattttggatagtttaagtaatagtagatagtttttgtaagtagaaatttatttattcgtttattattattttttttttttttttggaaatggagttttattgtgtcgtttagattggagtgtagtggcgggattttggtttattgtaatttttattttttaggtttaagtgatttttttgttttagttttttgagtagttgagattataggtaggtgttattatgtttggttaatttttgtatttttagtagagatagggttttattatgttggttaggttggtttcgaatttttgattttaggtgattcgttcgttttggttttttaaagggttgtgattataggcgtgggttattgcgtttggtttgttaattttatttattttaaaatttagtagagttaagtttattagataaaagtttttattaattatttttgatatttaggtaaattaaaatatatgaataggtaatggttttgagtttttatatagttttaattatgtgttagttaatttaagtatttattatgtatttaataataggtatgatatagttttggattttattaatattataagtagataggtataggtagtttgtatatatttttttttttggtgttaatattatttaaaagtatgggaaatagtaatgagatagtgttttttttattagaattttaggagtttattagatttttttatttttatttgttgttattagtagttaaattgtgtaaaaaatacggttttgagaaatgatagtatagtattttagagggaaaggaaatgtaggatgttagtgtggggataaatttttgattgttagtgattgttgtgagtataataataattttatgaatattaaagtttttattgagggtagttgtcgttgtaaaggaaaaaaaatggttttgaatatttaaaattatattggtgtatattataattaaataaagtaaatagaaaaaaatttaaattttgttaaaaaaaaaaagtagaagtatttgatttttaggaaggtacgtagttgtttattatgaattatttttagagttcgatgtatttttaaagtcggttatagttattacgaagtatatttttgtgaggtaagtgtattattatttttggtttataaataaaaaagttgagacgtcgagcgattaagttattcgtttaaggagaatgagttaacgttaagagttatagttgattcggtttaaagattttagattattagtttagggtttagttagcggggttcggagtggtttttttggttggtatttggatttaggttattttcgtgtacgtaaaagcggaatattggaacggttgtatagaatttttaaataatttttatcgttacgtaagatttagttttgaggttttaattttaggatttgggatagtaaaagttgtcgtttttttttttcgtttagtcggtggtaagcgggtattgcgggcggtttcgttcgttttttttcgtagaaatggtaacgaatgattattagtattagttgagttaggggacgtgggagggttgattgtttaaacgattttgtatcgtcgtttttttttgaaattaagagaaaatggtgggagattaaaagaaaattaaataaatatataggtaatttgttttgggattttaattaagtaaatgaagttttattgtgtgtgttgagtttgtagtttttaatttttcggggaagatgggaggatagggcgataaagggtatagtaggtttgtttggtagtaagtgtgatcgtagttatttaggcggaagagtagaggattgaaattattttttagtaagcgagtgttcgtcgcgttgagaatcgcgtattttatttatcggttacgtgattagttttttttaaaaaaaatttttttattttaaaaaaaaaaaaaaaaaaaaggtgggggagagattttattttttagaagtttttcgttatttacgtagtcgtagttttgcgtaggtgtcgttaggttaaacggatatattcgttacgtggttagaagttggttaattcggtttgaattttatttttttttttttatttttttttttggagcgcgttgtgcgattagatcgatttaagatggcgattgtcgaatcggtgagtattgtttttggttttatttttacggttttcgcgtttcgttttttttttgattgggggatttcgcgggacggcgttttcggcgcgtattgtattttttgtcgtttttttttttttatgttggatttgatttttcgcggataagtggggacgtttcggagatggtcgaggcggcgtgtagcgtatattttttggtgggggttcgagaattgggggagcggtgtgggggaggggcggcgtggcgttttttgcggaatcgcgaggtgtttatagggtggagggtagttggggttttgggttgggtatgcgaggatggtgtttttatgataggaaggcgtagggtcggtttttagcgagtattgggattcgtaggtagggtgggcggcgagtcggtttggagtgagatggaggagggagttttggagtagtttttttttttttgtagaattttagtttcggggttcgggtgcggggcgcgcgtacgttttttttagatcggtggattggggagttggtgggcgagtgttgtcggagggtgggttaggcgggagtggtgtcgcggtacgcgcggaggagtttcgatttcgtttaggggagttgagaggggcgagcgtttgttaatttagcgcgtcggagagttgtcggtgtttgcgttaggggaagcgagaaaggtttggggtgggaaggaatattcgtgtgttacggtgaagttttttaagtagaatgagggatggtggtggtgagaaggggtattatattgttttcgtttttttatgtttgggattgggttgttatggaggagggaagggggaggagcgaggtttatagatcgttgtagtcggtcggtttgtcggtcggatttgttgtattttatacgcgttcgttttttatttatttatttttttcgcgtagtgcgtacgttttagagaatgcgaatgggttttaatttttttgttttttcgagtttttattttttggaagatttt

SEQ ID NO: 44 - DNA, 6025 bp, Artificial Sequence
  chemically treated genomic DNA (Homo sapiens)
gaaattttttaggagataaagattcggaagaatagagggattgagatttattcgtattttttgaggcgtgcgtattacgcggaaaggatgaatgaatggaagacgggcgcgtgtgaaatgtagtaggttcggtcggtaagtcgatcggttatagcgatttgtaggtttcgtttttttttttttttttttttatgatagtttagttttaagtatggaggggcgaggataatgtgatatttttttttattattattattttttattttatttggagagttttatcgtgatatacgagtgtttttttttattttagatttttttcgttttttttggcgtaaatatcggtaatttttcggcgcgttggattaatagacgttcgttttttttaatttttttaagcgaggtcgaagttttttcgcgcgtgtcgcggtattattttcgtttaatttatttttcggtaatattcgtttattagttttttagtttatcggtttaaggaagacgtgcgcgcgtttcgtattcgagtttcggagttggggttttgtagggagggaaaggttgttttagggtttttttttttattttattttaggtcggttcgtcgtttattttgtttgcggattttagtattcgttgggagtcggttttgcgtttttttattatgaagatattattttcgtatatttagtttagaattttagttattttttattttgtagatatttcgcggtttcgtaggaggcgttacgtcgttttttttttatatcgtttttttagttttcgggtttttattagaaagtgtgcgttatacgtcgtttcggttattttcgggacgtttttatttgttcgcgggaggttaggtttaatatgaaggggaaggggcggtaaggggtatagtgcgcgtcgggaacgtcgtttcgcggagttttttagttagaaggaagacggagcgcggggatcgtgggggtggggttaaaggtaatatttatcggttcgatagtcgttattttagatcgatttgatcgtataacgcgttttagaagggggggtaagaggaaaaaaatgagatttaaatcggattggttagtttttggttacgtgacggatatgttcgtttggtttggcggtatttgcgtaagattgcggttgcgtgagtaacgagaggtttttgggaagtggagttttttttttattttttttttttttttttttttaaggtaaagaaattttttttaaaaaggattggttacgtggtcgatgggtagggtgcgcggtttttaacgcggcggatattcgtttgttggagggtggttttagttttttgttttttcgtttggatagttgcggttatatttattgttaggtaagtttattgtgttttttgtcgttttgtttttttatttttttcggaaggttgggaattgtaggtttagtatatataataaggttttatttgtttagttgaggttttaggataagttgtttgtgtgtttatttagtttttttttgattttttattatttttttttagttttaaaaagaggcggcgatgtagagtcgtttaggtaattaatttttttacgttttttggtttagttaatgttggtggttattcgttgttatttttgcgaaaggggacggacggaatcgttcgtagtattcgtttgttatcggttggacgagggggagggacgatagtttttattgttttaaattttgagattaagattttagggttaaattttgcgtggcggtaaaaattatttggaagttttgtgtaatcgttttaatatttcgtttttacgtgtacggaaatagtttaagtttagatgttagttagggaagttatttcgggtttcgttgattaagttttggattgatggtttggagtttttaggtcgggttaattatgatttttgacgttgatttattttttttaggcgagtgatttaatcgttcggcgttttagtttttttatttatgaattaaaggtgatgatatatttattttataagggtgtgtttcgtaatgattgtaatcggttttgaaaatgtatcggattttagaaatgatttataataagtaattgcgtgtttttttaaagattaagtgtttttgttttttttttttagtaaagtttaaatttttttttgtttattttgtttgattatgatgtatattagtgtagttttaaatgtttaggattatttttttttttttataacggtagttgtttttaatagaggttttaatgtttatgaaattattgttatgtttataataattattggtaattagaaatttgtttttatattggtattttatattttttttttttttaagatattgtgttgttattttttaagatcgtgttttttgtatagtttggttattaataataataaatagagatgaagaaatttagtagatttttaaggttttaatgaagaagatattgttttattattattttttatgtttttaaataatgttgatattaggaaaaggagtgtatgtaggttgtttgtgtttgtttgtttatagtgttaatgaggtttagagttgtgttatatttattattgagtatataatggatgtttgagttgattaatatataattgaggttgtatgagaatttaaagttattgtttgtttatatgttttggtttatttgaatattagaagtgattaatgaaagtttttgtttagtgggtttagttttattaggttttaaagtagatagaattaataggttaggcgtagtggtttacgtttgtaattatagttttttgggaggttaaggcgggcggattatttgaggttaggagttcgagattagtttgattaatatggtgaaattttgtttttattaaaaatataaaaattagttaggtatagtggtatttgtttgtagttttagttatttaggaggttgaggtaggagaattatttgaatttgggaggtggaggttgtagtgagttaagatttcgttattgtattttagtttgggcgatatagtgagattttatttttaaaaaaaaaaaaaaaatgataataaacggataagtggatttttatttatagagattatttattgttatttagattatttaaaataattttgttgatcgcgttgttattttttgttggttagaagtggtgttaggttattttttttgaagagaaaaagatagtatagatgttttattttttttttttttatttttttttatttttttttttttttttttatttttttttttttttttttttttttttttttttttttttttttttgtttttttttttttttttttttttttttttttattttttttttttttttttttttttttttttttttttttttttttttttttttttttttttttttgtttttttagggtgttgttttgttatttaggttggagtgtagtggtatgattatggtttattgtagttttgattttttgggtttaaggggtttttttattttagttttttaagtagttaggattataggtatgggttattattgagttaatttttttatattttgtagagataggagcgtttattatgttttttaggttggttttaaatttttagggtttaagcggtttttttatttgggttttttaaagtgttgagattgtaggtatgagttattatttttggttagatgttttatttttatgaagttgttatataatagtaaaaaattaatgagattggtaagaaaatatttataggattgaaagttagtgatgtttttaaaattttttttaaataatagtttttatttttattaaattttttgttaattaaaaaattcgggtcgggcgtggtggtttatgtttgtaattttagtattttgggaggtcgagcgggtagattacgaggttaggagatcgagattattttggttaatacggtgaaatttcgtttttattaaaaatataaaaattagttgggtatggtggtgggtgtttatagttttagttacgcggtaggttgaggtaggagaaaggagtgaatttagggggtggagtttttagtgggcggatatcgcgttattgtttttttttagttttaaaaaaaaaaaaaaaaaaaaaatttttttttgttaattaagatttatatttttataatatttatggatgttttattttttatggtttagtttttttttattttttatatagtttttaataatttttttttataatttttaagtatagagttttaggaaaatttttatttttgtatatattttgttgtgtgtgttttatgattattaatgtgtttttgtttatttgagattttattattttaaagatttaacgattaggtttttatgtatgtgtgtatgtggttgttttgttttgtttttgttaattttaaatatatagagttgaaattttatgttttatttttttatttattttttattattttttattgttttttaaaggatttgtaattttaagtttatttatagaattgattagaaattatttaataagtattaagttagtaatgggaattatgtaattagtggaggatatttaaaggatataggaagtataggtattttttttttcgattgtaaaatttggttggcgtattaagttatagaaatataaatagtttagtatttatataaagaggtgtgattaagaattaagaggatgtagttaataagtattataattagtatatatttatataatgaatgagcgaattatatattttttttttttattttatttaggtttttgttttaatgtgattttttgaaggaaggtttttttgattattttatttaaattattgtttttattattttttatttttttattttgttttggttttttttaggttattttataattttaattttaaatttgttgttaaatattatttaattagttgttgattgattttattattaaaatattagtttattgatgatttgtagatagattgttattaaatatttggggaaaatttaaatgtaatttttttttttcgagatgtagttttattttgttgtttagattttggtttattgtaatttttgttttttgggtttaagcgatttttttgttttagttttttaaatagttgggattataggtgcgtgttattatatttggttaatttttgtatttttagtagagatggttagtttggtttcgaatttttgatttcgtgatttgttcgtttcggtttgttaaagtgttgggattataggtttgagttattgtgaatttttattttaattttatagtttgagagatattaatttttattatttatttaggatattgtttaaaaatatgggatgtacgtaaatatgattaaggaattttgaatattaaaagattggagtagaattggaatttaaaaaattattttattattttagttagttttttgtttattttttttttggtgatttttatgagattgaggtattatttattggttaaaaaggtattttgatttttaaaagaaaattaagaaaaagaaaaagaaaaaaattttttaagggaaattttttttgttattttaatatattcgtgtgttaatattttatgtttttataattatagggtgtaaagagtttttgtttgtttgtttagagatagggtatttttatattattaggttggagtgtagtggtataattttggtttattgtagtttttaattttggggtttaagcgatttttttattttagttttttgaacgatggttaagattataaatatgtgttattatgtttagtttatttttttattttttgtagagaaaagattttgttatgttgtttaggttagtttcgaatttttgggtttaagtgattttttggttttggttttttaaaattttgagattatatgtatgagttatttttagtttgtataaataattttgaattttatatttttttttatatgatattttattgtaaatattttggatattgtttatagatgggataatagtttttaaat

SEQ ID NO: 45 - DNA, 6544 bp, Artificial Sequence
  chemically treated genomic DNA (Homo sapiens)
gggatgtttgggttttaataattgtttttttatttggagaaattttttttattttttttaaattttagttttttttttttgggatttgttttagttataaatgttgtaattttttataatgttttgatttgttatagtggttttgaaattttgattgtatattggaattatttagagagttttaaaagttattgatggttagattttattattaaagatttagatttatttggttttaggtgtagtttggatattgagatatttaaaagttttttaggtgattttaatgtgtagttaaggttgagattaatttatgtagaaaatagtgaagtattaagatttttaagtatggtaataatatgttaaaatttagtttagtttttttgttttttttgttttttttaagacggagttttgttttgtcgtttaggttggagtataatggtatgattttaatttattgtaatttttattttttgggtttaagcgatttttttgttttagtttttcgagtagttaggattataggtgcgtattataacgtttggttaattttttgtatttttagtagagatagggttttattatgttggttagggtggtttataatttttgattttgtaatttgtttgttttagttttttaaagtgttgggattataggtatgagttatcgcgtttggttgaaaaaaggtattttaagaaagattaataggaatatatagattagtagggaaagattatagaagattaattagaattttgtaataatttaggagaaaagtttagtaagggttggattagtatatatgtaatgatgttgtagggaggaagatgaatgtaagaaatatttggagagaaggagtattaggatttagtaagtgattgaatgttaaatttgagtaaaaggaaaaaaaatatggttaagtttttagtatagaagaataatagattttttaataaaattaaagtagttgtgaaatagttggttaattaatattattgagaatatggaaattaatattaaattttaagtcggggtttaatttacgtgttttatatatattattttatttaatttttataattattatataaatattattattatttcgattttatagttttagaaattgagtaagagtaattaaattatttgtttaaagttatatagtaaatggtagagaagatatttgattttaattggtttaattatttttttttataggaagatgattagtttatatatggaatttgttgaatttgagtaaataatttaaaaaagtaaaatggttatagaggttagatgggaatataaatgagtgaattaagttagatgtaattgtggagaaattaaaatatcgagagaaggtagttttatttagttatgtttgaatgttgttttatgagaattttaggtttagtattgttatattttaagattttttatgaaaagatggaaatttggatttgtatgtaaaaatttgtgtgaatattaaatttaagtgtttaaaattattgtggtttaaattatggttttaagtttgtatttttgagtaaaaggttgttggaaatttagaattggatgtaaagtgagagatttgggttgaaggtaaatgattagggaatttataagtatagagaggatggtagatgtttttaaaatagtatgtgttagaatagtaattagtatttgatatgattagttaaaataaggtaaaaatatatgagttaataagttagttaggatttagagaaaattgataaaattagtagtggaaaattagtagatttaagtgggtatatttaaaatttaatttttaatgaattaaaagttaaattttagataatgattttgtgtgtgtgtgtgtgtttaagataggatttcgttttgttatttaggttggagtgtagtgatatgattatggtttattttagtttcgatttttagggtttaagttattttattgttttagttttttaagtagttggtattataggtatgtgggatataggttaatttttgtattttttgtagagataggtttttattacgttgtttaggttagttttaaatttttgagtttaagttatttatttgttttagtttttaaaagagttgggattgtaggtattagttattatgtttagtattttattttttttgagataggattttattttattgttttggttggagtgtagtggcgtgattatggtttagtgtagttttaaagttttgggtttaagggattcgtttatgttagttttttaagtagttgggattatagatgtatgttattatatttggattaatttttaattttagagatgggggggtttttttatgttgtttagattggtttttaatttttgggtttaaagaatttttttagtttggtttttaaaagtgttgttgaatttttatatatttatgacgtgatggaaatatttagaaagttttaatgtttattttttttatttaaatatatttcgatttgaaaaaaaattattgtttagattttaaagagtatatttatttagttttaaaagttagatgtttttataattaagatatttaaaatttaataattaaaaattttttatattgggtatagtggtttatatttgtaattttagtattttgggaggtttagacgggtggattatttgaggttaggagtttgagattagtttgggtaatatggtgaaattttattttaagtagaaatataaaaattagttgggcgtggtggtatatgtttgtaattttagttatttaggaggttgaggtacgagaattgtttgaatttaggaggtggaggttgtagtgtgtagagattatattattatattttagtttgagtgataaagtgagattttgttttaaaaaaaaatttttttttttaaaggttttatttaatgtttttatttaatttttgttaattgtgaatttttttgtaatgggttttgtaggtacgattttaattttaaatttttttatttaagtgagagaaaggtaattgaaagattgttttattaatatttttattttttttattttaggttatttttttttaggttaattttttatataaatttatatttgtaaagtttatattaaaagggtttttaattagtaaagattaaataaaatattaagtaaaattttttttaaatttttaattattgaattttaagtgttttaattataagaatattcgatttttacggttaggtgaatattttttttgaagtttagataatagtttttgaatattattttttttagtaaattaatgtattcgtttattattagataaatggaatgtaaattagttatgtaaaaatattatatatattaatgtatttttttaaattttaaagttttatagaaattataaagaaatattattttcgtgttattatgaagttagaagggtttaaagaaatataaagtgaaattttttgtatttaaaataaaatttgtattattattattattttaaaatagtttttttttttttttagaatattttttttaagttttaaagtttaagtaaaattgatgtaatagtaataagtgtagtaatagtaaagtagggaatggtgattattttatagtaaagatttatagatgttggaattgtgttaaaaatttttagagttatattatagttttttattatatttaaatgtcgtaggaaaaattgtaatttttcggaaaattgtattaaggattaggtgttttaatattaagagttgttttgatatattaaaggttaagtttgggtttttgaaaattttgttttttattgaatattttaaaagttatttatgttaaaatatatatatttttgtttttgattatatattgtaaaagtattatatgttaaaatggagatggggatatttttgttgtttaagtttatggaagtatgattttattttagtatagttataatgtcgtaaacgatggaataaggtatttattaatatattatttggtaagtataaatagtttaatttgtcggttttgaaaagtttaattttattttttatggtgaattttaaataaaatgaaaatatataattgataatgtttaacgtgtatttaaataaataaaaaataaaaaaaaataggagttagtaattcgaaattttttaaatattcgcggaagtttgatatatagggtgtttttttcggtgatcgttagtcggatatttttatgggaaaagtagttttttttgtgcggttcgaagaaaattaattttttttttttattatttttttatttattttgtagggggtgggttaataaggagttgaatgaagtttttttttggtattcgggcgtacgtttcgttttttttttattattttttgggttttttaaggttgtcgaagtcgaggatttggagtcgggtagtgtttcggcgttgcgttcgggggttttaggttttaattcgaagggtttagtttcgggagaggttaggtacgcgagggtagttatagttttaaggggcgttaagaaaagtaatgtttattcgttacgtatagggttcgggggaggtaagggtgcgttttttttttatattttcggtgagaaaacgaggtcgagggaaaaggggatgatataattggagtatggtatatggatttagtgaataaagggattggagtaagaagtagtagttacgttaacgtagatttaaaagggtttttcggttttacgtacgtaatttttatttcgatagcgttcggcgttttttacgttattggtttagttttagagatttcgcgaatatggttttgcgtattgcggcggggttgcgtcgtaatcgagtttagttttgtggttttttttcgttgttttgcgcggattggtggtagacggtaatcgggtcgttgattgggcggcgaaggagttattcggggagattttggtgggttcggttgttttaagagtgataagttcggttttagatacgttttagcgttagtagtgagtcggagttttatggaggtggtagcgggtatcgagtggcggttgtagtagcgatttttttgagttgagtttgaggtcgttttcgatttttttttttttttttttttttttttttttttgtttttcgtttttttttttttttttttttttattttcgacgatcggattttgaggaggtagttgcggtggtagttgttgagttttcggtgaaggtgagttgagtcgttgtcgtcgtcgagtggagcgttttaaaatggtcgtcgtttttggtcgttttttttcgagtggtataaaatggcggtcgtaggcggagtcgggtggggcgatttttttttagtattttttttgcgttttagatatttggaaagttttggtttttgttttttttttttgttgttgacggagtagaaggaaaacgttagtgttggttaggtcgtcgtgcggttatggtcggatggtcgacgtttgtagggacgaggtcgtggcggatcgaggtacggttgtgttcggacggcgagggagcgtggttcggatcgttagcgtcgtggcgggaggtacgcgggtcggtagggaaggttaggtcgttggcgcgggattagggaatcgtaggcgtttcggagtttggtttttcggcggggaggtgtgtaggatttggagtcggtaggggttgtttttcgtcggggaggaaagagagagtgatgatttttgttttttttgttagtagaggaggtcgtggcgaggcggttgttagtttcggggggatttatggtgtaggagggggttcgtttggaggcggcgggtgggtaggaggtcgtttttttgtttggagaataaagagttgggcgtcgggttggcgggggtggttttagttgttttttttcgtcgagcgattcgggtttcgcggggaggttgtcggaagtatttttttaatttgcgtttgggtgggaggaatgtttcgtttttttgtttttaggaagggaaaaacggggcggaggtttttgttgttatgttgtggttttggtttttcgtttgtaagtgttagttttgtatattcggttttttttcgcgcgtttttttacgagttttttacggggaggaggcgaaagggtggataggggaaaattgttgaagagttttcggagagattttatttagtcgttggtttcgttaaggtagtaaaaatttttagggtagatattttttacgtgatgttgttcgtgtttgtagttagatttttttattgattttagtgtttagttttaaagatagtagaatgtggtttttttaaaagattcgttttgagtcgtttaaaatgtttttgtgttttacgaagtttttttgtatttttgaatatcggggaatttttaggtggttaaataaaatgtaattgttagtgttttgagtatattttaggttagttttatagatttgtaatgtagtgatagtgttaggatttgaaatacgttgtaattgaatgaaggtttatagatttgtatgttagtagtgtttaattttggtgttttttttcgttttagg

SEQ ID NO: 46 - DNA, 6544 bp, Artificial Sequence
  chemically treated genomic DNA (Homo sapiens)
tttggaacgagaaagagtattaaaattagatattgttaatatatagatttataagtttttatttaattataacgtattttagattttggtattgttattgtattgtagatttgtaagattaatttaaaatgtatttaaaatattgataattatattttgtttagttatttggaaatttttcggtgtttaaggatgtaaagagatttcgtagaatataagagtattttaaacggtttagaacgaattttttgaaaaagttatattttattatttttaaaattgagtattgagattaatagaaaagtttaattatagatacgagtaatattacgtggaaaatgtttgttttaggaatttttattgttttgacgaggttagcgattagatgaggttttttcgaaagttttttagtagtttttttttgtttattttttcgtttttttttcgtggagagttcgtggaaagacgcgcgagagggggtcgggtgtataggattagtatttgtaggcggaagattagggttataatatggtagtaggaattttcgtttcgtttttttttttttgggaataaaagagcggagtattttttttatttaggcgtaagttagggaagtgttttcgataattttttcgcgaggttcgggtcgttcgacggggaggagtagttgaggttattttcgttagttcggcgtttagttttttgttttttaagtaggaaggcggttttttgtttattcgtcgtttttaagcgggtttttttttgtattataaattttttcgggattgataatcgtttcgttacggttttttttgttgataaaaggggtagaaattattattttttttttttttttcgacgaagggtagtttttgtcgattttaggttttatatattttttcgtcgggaggttaggtttcgggacgtttgcggttttttggtttcgcgttaacggtttggttttttttgtcggttcgcgtgtttttcgttacggcgttagcggttcgagttacgttttttcgtcgttcgagtatagtcgtgtttcggttcgttacggtttcgtttttgtaggcgtcggttattcggttatgatcgtacggcggtttggttaatattgacgttttttttttatttcgttagtaataggaagagagaataaaagttaagattttttaggtatttgaagcgtagaggaaatgttaaaaaagggtcgttttattcggtttcgtttgcggtcgttattttgtattattcgagaagaagcgattagggacggcggttattttagagcgttttattcggcggcggtagcggtttaatttatttttatcgagaatttagtagttgttatcgtagttgtttttttaggattcggtcgtcggggatagggaagggaggggaaaggggaacggaaaataaaaaaaagggggagggaagggggaggaaggagtcggggacggttttaaatttagtttagaggagtcgttgttgtagtcgttattcggtattcgttgttatttttatagagtttcgatttattgttggcgttaaggcgtgtttgaagtcgaatttattatttttggggtagtcgaatttattagagttttttcgaatggttttttcgtcgtttaattagcggttcggttgtcgtttgttattaattcgcgtagggtagcgaggaggagttatagggttgagttcggttgcggcgtagtttcgtcgtagtgcgtaaagttatattcgcgaagtttttgaggttgagttagtggcgtaaggggcgtcgagcgttgtcgagatgagggttgcgtgcgtaaagtcggagagtttttttgagtttgcgttggcgtggttgttgttttttgttttagtttttttgtttattgagtttatatgttatgttttagttgtattatttttttttttttcgatttcgtttttttatcgggaatatgggaagaaaacgtatttttatttttttcgaattttgtgcgtggcgagtgagtattgttttttttggcgttttttggagttgtggttgttttcgcgtgtttggtttttttcggggttgagtttttcgggttgaggtttggagttttcgggcgtagcgtcgggatattattcggttttaggttttcggtttcggtagttttagggaatttagaaagtagtggggaggaggcgagacgtgcgttcggatgttaaaggggagttttatttagttttttattggtttattttttgtagagtgaatgagaaagtgatgaaaggaaggggttgatttttttcgaatcgtatagaagaagttgttttttttataggaatgttcggttggcggttatcgaggaaaatattttgtgtgttagattttcgcgggtgtttggaggatttcgaattgttagtttttgtttttttttgttttttgtttgtttaagtgtacgttaaatattgttagttgtgtatttttattttatttaaggtttattataagaaataggattaagttttttaaagtcggtaagttgaattatttatatttattaggtaatgtattgatgagtattttattttatcgtttgcgatattgtagttatattaaaatggagttatatttttataaatttaaataataaaaatgtttttatttttattttaatatgtagtatttttatagtgtatagttaaaggtaagaatgtgtgtgttttaatatgaatgatttttaaagtgtttagtaagaggtaggatttttaaagatttaaatttaatttttgatgtgttaaaatagtttttggtattagagtatttggtttttaatataatttttcggaaaattgtagttttttttacgatatttaaatgtaatagaaggttgtggtgtggttttgaaggtttttaatataattttaatatttgtagatttttgttatagaatagttattattttttattttattgttattatatttattgttattatattaattttatttgaattttaaaatttggaagagatattttaaaaaaaaaaaaaaattattttggggtggtggtggtggtgtaagttttgttttaaatataagaggttttattttgtatttttttggatttttttagttttatgataatacgagaataatgtttttttataatttttgtagggttttaaggtttggaaaaatgtattagtatatgtgatatttttatataattggtttatattttatttatttgataatgaacgaatatattagtttattaagaagagtagtatttaaaaattattgtttagattttaaagagaatatttatttagtcgtaaaagtcggatgtttttataattaagatatttaaaatttagtaattaaaaatttaaaaaaggttttatttaatattttatttaatttttgttaattgggaatttttttggtatgggttttgtagatatgagtttatgtgagaaattgatttggaagggaataatttaaggtagaaaaagtaaaaatattgataaaataattttttaattattttttttttatttaaatagaaagatttgaagttgaaatcgtatttgtaaagtttattgtagaagggtttataattagtaaagattaaataaaaatattaagtaaaatttttagaaaaaaaaatttttttttgagatagagttttattttgttatttaggttggagtgtagtggtgtgatttttgtatattgtagtttttattttttgggtttaagtagttttcgtgttttagttttttgagtagttgggattataagtatgtgttattacgtttagttaatttttgtatttttatttgagatggggttttattatgttgtttagattggttttaaatttttgattttaagtgatttattcgtttgggttttttaaaatattgggattataggtgtgagttattgtgtttagtgtaaaaaatttttaattattgaattttaagtgttttaattataagaatatttagtttttagggttagatgaatatattttttgaagtttagataatagtttttttttaaatcgaaatatatttaagtgagggaaataaatattgaaattttttaaatgtttttattacgttatggatatatgaaaatttagtagtatttttggaggttaagttgggaggattttttgagtttaggagttggagattaatttgggtaatatagggagatttttttatttttaaaattaaaaattaatttagatgtggtgatatgtatttgtagttttagttatttgggaggttgatatgggcgaattttttaagtttaggattttgaggttgtattaagttatggttacgttattgtattttagttagggtagtagagtgagattttgttttaaaaaaaataaaatgttaggtatggtggttgatgtttgtaattttagtttttttggagattgaagtaggtgggtagtttgagtttaggagtttgagattagtttgggtaacgtggtgaaaatttgtttttataaaaaatataaaaattagtttgtgttttatatgtttgtagtattagttatttgggaggttgaggtagtaggatggtttgagttttggaggtcgaggttgaagtgagttatgattatgttattgtattttagtttgggtaatagagcgaaattttattttaaatatatatatatatatagagttattgtttggaatttagtttttagtttattgaaaattgaattttaaatatatttatttaagtttgttagttttttattgttagttttattagttttttttaagttttgattaatttgttaatttatatatttttgttttattttaattaattatgttaagtgttggttattattttaatatatattgttttggaagtatttattattttttttgtgtttatgaattttttaattatttatttttagtttagattttttattttatatttagttttgaatttttaatagttttttgtttagagatgtaaatttgaagttatagtttgagttatagtagttttaaatatttgaatttgatatttatataaatttttgtatataaatttagatttttatttttttatgaaaaattttaaaatatggtaatattgggtttgaaatttttatagggtaatatttaagtataattaagtagaattattttttttcgatgttttgatttttttatagttgtatttgatttgatttatttatttatgtttttatttggtttttatagttattttgtttttttgagttgtttgtttaaatttaatagattttatatgtaaattggttatttttttatgaggaaaagtagttagattagttgaggttaaatgttttttttattatttattgtgtaattttgggtaaataatttaattatttttatttagtttttaaaattgtaaaatcggaatgatagtagtatttatatggtggttgtaaagattaaatgagataatgtatgtaaggtacgtaggttagatttcgatttagaatttaatgttagtttttatatttttaataatattgattaattagttgttttataattattttaattttgttaaggagtttattatttttttatgttagaaatttgattatattttttttttttttgtttagatttaatatttaattatttattgaattttggtgttttttttttttaaatgttttttgtatttatttttttttttataatattattgtatgtatgttaatttagtttttattaaattttttttttggattattgtaaaattttagttgattttttgtagtttttttttattagtttgtatatttttgttagttttttttaaaatatttttttttagttaggcgcggtggtttatgtttgtaattttagtattttgggaggttgaggtaggtagattataaggttaggagttatagattattttggttaatatggtgaaattttgtttttattaaaaatataaaaaattggttagacgttgtggtgcgtatttgtaattttagttattcgggaggttgaggtaggagaatcgtttgaatttaggaggtggaggttgtagtgagttgaaattatgttattgtattttagtttgggcgatagagtaagatttcgttttggaaaaaataaaaaaaataaaaaaattaaattaaattttaatatattattattatgtttaagaattttagtgttttattattttttatatgagttgattttaattttggttgtatattagaattatttggagaatttttaaatattttagtgtttaggttgtatttaagattagataaatttgaatttttggtagtgagatttagttattagtagtttttaaagttttttaggtgattttagtgtgtagttaaggttttagagttattgtagtaggttagagtattatagaaaattataatatttatagttgaagtaaattttaggaaaaggaaattggggtttaaaaaagataaggggagtttttttaagtagggaaatagttattagaatttaggtatttt

SEQ ID NO: 47 - DNA, 7317 bp, Artificial Sequence
  chemically treated genomic DNA (Homo sapiens)
gggttttatcgtgttagttaggatggtttcgattttttgatttcgtgattcgtttatcgcggttttttaaagtgttgggattataggtgtgagttatcgtttcgggtttaatttttgtatttttaatagagatagggttttattattttggttaggtttgttttgaatttttgattttaggtgatttatttgttttggttttttatagtgttgggattataggcgtgatttatttttttttttttttttttgaaatagggttttattttgtcgtttaggttggagtgtagtggtatgattttttagtttattataatttttattttttgggtttaagtaatttttgtattttggttttcggagtagttgggattataggtgtgtgttattatgtttagttaatttttttgtatttttagtagagacggagttttgttatgtgggttaggttggttttaaatttttgatttttagtgatttgttcgttttagtttttaaaatgttggtattatatgcgtgagttattatatttagttttaattttgttgttttgaagttattttaagagttattttgattgtttttgtgtgatttatatttttttgttattagttatttttaatatggttaattttaggtttagggttttggggaaaggttagaggagtatattttaagaagatgttttaagtattagagttttgtatgtatagtagagtcgggggttatggtttttgattttttttggttgaatttttttatgggatgttttttagattttttttaatttattttttatatttagttttatagtatttttggttaggtgggtaaggtatgtttgaatgttgttttgatttaagttggattttgtgtaaaattaagtaaattttttttttaaagtttatagaaattttttaaaaagaaaaaaaaaaaagttgggtgcggtggtttacgtttataattttagtattttgagagtttaaggtaggcggattacgaggttaggagttcgagattagtttagttaatatggtgaaattttatttttattaaagatataaaaaattagttagcgtggtggcgtaagtttgtaatttaagttattcgggaggttgagatagtagaattgtttaaatttggtaggcggaggttgtagtgattcgagatcgtattattgtattttagtttgggtgatagggcgagattttgttttaaaaaaaaaaagaaaagaaaagaaaagaaaagaaaaagaggttaggttcggtggtttatgtttgtaatttttgttattagggatattagggaggttgagttaggagaattgtttgaatttgggaagtagaggttgtagtgagttaagattatgttattgtattttagtttgggtaatagagtgagattttgttttataagaaaaaaaagaaatttttaaaaaaaaaaaaattagttggggttaggtatagtggtttatttttgtaatagtattttgggaggttaaggtgtgtggattaattgaggtgaggagtttgagattagtttggtatggtgaaatttcgtttttattaaaaatatataaaattagttgggttcgtggtggtgtatgtttgtaattttagttattagggaggttgaggcggaagaattatttaaatttgggaggtagaggttgtagtgagcggagattatgttattgtattatagtttgggtgatagagtaaggttttgttttaaaaaaataagaaaataaataaataaaaataggtcgggtgtagtggtttacgtttgttattttagtattttgggaggttaaggcgggtagattacgaggttaatagatttaaattattttgattaaaatggtgaaattttatttttattaaaaatataaaaattagttggatgtggtggcgtatatttgtagttttagttattcgggaggttgaggtaggagaattatttgaatttaggaggtagaggttgtagtgagttgagatggcgttattgtattttaatttggtaatagagttagatttcgttttaaaaaaaaaaataaaaaaaaaaaattgggtaagtaattttttattaggaaatgatagagtaagtttttaggtgttttttatattttttatttttttgttttgttttttaaaatatttatttatttattttaagagataggattttttattttattgtttaggttgtagtgtagtggtatgattatattttattgtagtttcgattttttaggttgaagtgatttttttattttagtatttggagtagttggattataggtgttgtgtatattatcgcgtttaagtaattttttttttttaatttttgtagagatggggaataggggggtttttttatgtttgttgggtttaagcgatttttttattttcgttttttgaaacgttgggattataggtatgagatattgtgttcgattaatatttttttttttgtattttttagtttgaatatgggtataaattattaaaaataataaaattatttttgaaggttaattttgattttatttttatatattgaatttattttgtaataattttaagataaagaagttttgttttttttaatttgtttgttttttttttttttttgagacggagtttcgttttttcgtttaggttagagtgtagtggcgcgatttcggtttattgtaagttttatttttcgggtttacgttatttttttgttttagtttttcgagtagttgggattataggtgttcgttatcgtgttcggttaattttttgtatttttagtagagacggggttttatcgtgttaattaggatggtttcgattttttgatttcgtgattcgttcgttttggttttttaaagtgttgggattataggcgtgagttatcgtatttggtttttttttttttttttgagatagagtttcgttttgtcgtataggttggagtgtagtgggcgatttttgtttattgtaggttttgttttttaggtttacgttatttttttgttttagtttttcgagtagttaggattataggtgttcgttattacgtttagttaatttttttgtgtgtgtttttagtagagacggggttttatcgtgttggttaggatggttttaattttttgattttttgattcgtttttttcggttttttaaagtgttgggattataagcgtgagttattacgttcggtttaatttgtttgtttttttattgtagtttgggtgatttaggtttgattattagaggatagattttatttttgttagtaattttaattgttttattaggatttttatttttatgtttttatttatttattttaatattaatttaaaaaataaatagaaataatataaaaaaaaaaataaagaaaatttaataatttgtaaatattagttacggagtatgagatatgaaataaaagaaaaaaaatttttttttttttgggatagagttttgtttttgtcgtttaggttggagtgtaatggtataattttagtttattgtaattttcgtttttcgggtttaagagatttttttattttagttttttaagtagttaggattataggcgtgtattattatattcggataagttttgtatttttagtagaaacggggttttattatgttggttaggtttgtttcgaatttttgattttaggtgatttattggtttcggttttataaagtgttgggattataggcgtgagttatcgtgtttggtcgagaaaaagtttttaatcgtattagtagatattggtttcggggtttttttcggggttatttatatttttgttattttttttagtattaatttatttatggttaaatatagggtgatgtgtaggaatttgaaagtacgttttcgattttagttgtaaaattgtggagttttatatattagattttatattttagtatttttttttattattatatttttgtttttttttatttttatattatttttattatatttttgttttttttataattatattagataaggtaatggttagacgtggttttttattaatttgttttattgggagcggacgagaaaaaaaaaaaagataaattttagaaatgtttttaggttttagttatgtttaggaaaatatttgaaggtttttgcggtgagagtgttatttggtaagggcgtatggatatacgtggagggtaagaaatgaatttgggtttggtgtcgaaatatttttttattgttgtgattttgttttttggttagagtaataatgttcgttgtaaaataaataaataaataatatataaaaaggaaaaggaaaatttagagaaaatgaaaataattcgtaattaacgtgttttttggatgtgaattgttttttttgggagggtaatggagaagtgaggacgtattgggtatttggttcggaatagtcggtagtgggtatattttgtttggtgaattcgatcggggttttgggggattcgttatttaagggtcgaagagtagggtcgttttacgggcgtttttatttggttatttgagtggcgatttggcgtttttttcggagtagtttcggggtttcgtcgtttcggtttttattggttttttacgtagagattaaaggtaggaattttttttcgtaattatttatcgattgaaaatagattttgagttcgttttcgtttttttttttttaaaattttttttatttttaaaatttttttttttaaagggagttatagggtgacgtcgggggagtttgcggaagcgttaatcgcgttggggtttagggcggatttcgtgattgggataggtttcgttttcggttttattttttttattgtgtgagcggttcgggtttaggtttcgttttttttcggaggttcggttattttttttttttatttttttttggtttattttcggtcgtcgtcgttatcgttagtttgtaaggaggattcggtagagggaagaaataatagtcgttattttgtttgtgtgttaggttgggggggagagagggcgagagagagcgggcgagagtgggtaagtaggacgtcgggttgagtgttaattgcgggagttagagagtgcggaggggagtcgggtcggagagaggcggtaggggtcgagatagtggtagggggttcggggcgtacgggttgaggcgatttttagttttttttcgttcgtatatatttttatcgcggtttagtagtcgggtcggcgtcgacgtttaggggggattattatataatttcgcgtttcgcggcgttttttttcgtcgtcgcgggcggtttcgaacggagtttcggggggcgggcgtttttagtatttggtcgtcggcggtgggggtcgtagtagcggtcgtatttatttatttttcgcgggaaaggaaggcgaaggaggggagcgcggcgcgaggaggggtcgtttgcgtcgtcgtcggagcggggttttttcggtgggtttcgcgtcggcgcgggcgtgcgggcggcgttgttcggttcggttttttcggttttttggttcggttagtttcgttttcggcgtttttgtcgcgttttcgtcggtcgtcgcgcgatgtgaggcggcggcgttagtttggttttcggttcgggcgagttttttgcggttattaggggtcggtgcggcggcggcggcgcggagcgcggcggtaggaggagggttcggagggtgggggcgtaggttcgggagggggtatcgggaggaggtgagtgttttttgtcgtttttttttttttttttttttcgttttcgtttttttgtggcgatgagaaggaggaggatagcgtcgaggaggaagaggttgatggcggcggcggagtttcgagagatttcggttgggtaggggtcggtcgtggcgggtcggggattgcgtttttagagtcgcgagttttcgggaattcgtcgtagcggacgcgttcggcgaatttgtgtttttgtgttttttttcgggtttgggtttaggttcggtttttcgtatttgtttttattttttttatcgagttcgtatttttttttagttattgcgattcggcgaagagaaaaaggaattttttttattttttcgggtgtcgtcggagttttttagtttatttttgggtgcggcgcggggatttcgggtcgaagaagagattttttgaggattttggtttttttcgtttgtattttcgaaagaattaaaaatggtcgagaatgtggtggaatcggggtcgtttttagttaagcggtttaaatttttattttcggttttttcggcgttcgttagcgatggtataggttagtttcggtagtttcggttttttacgttttttttaattttttttattcggtgcgtttttatttttttattttttttttttttttttttttttagttttttgttttttaattaattttaaaggtatttgaatgagttggtcgaagacgtttagtagtttaattattttttttgttttttaatatattgattgtaatattatgttatatcggtgtgtgttttggaattagagttcgtaagtgggtgttatatagaaatggtttgtattgttgtttttatgtaatttaatttgggaaatgttaatgtatttgtgtgtaagagtttttatgtaatttaagttttattttttttgtttttggtaaatgaatttcgaattttttttttttattgtatttattgtgttttttttattttttatttttcgaaatttttttttttttgtagaatattttttgttgaggaatagggtgtaaaaaaattttgattttgtgtgtgcgaggtttaagattttaggttagaggtgaagtttaataatttttttattttatttattatttttagttttttttttttttttttttttatttgttttaagaattaatatggagcgtagtttattttatattttttagttttttggtgtgagattaaaatgtttgaaattttgggtttttaggttgggagaataggggtatgttttttgtagtttgtagttatttttttattttaggggaaataagataaataattttgtggagttacgtatttggaaattaaggttagaagttgaaagagttttaattatgaattataaacgtgaattgattgtataaaagtttaaaatgtgtattaggtttggtgtttgtgtgtgtttttgtttttttatatttttaaatatatttggagattaagattttcgtttaaaagttttacgattagtttatttagttgtggattagtttttttgttaggagaagtttagggagattttttttattattt

SEQ ID NO: 48 - DNA, 7317 bp, Artificial Sequence
  chemically treated genomic DNA (Homo sapiens)
ggatgatggaagaagtttttttgaattttttttgataaaggagttagtttataattgaatgaattggtcgtaaagtttttaaacgaaaattttgatttttaagtatgtttaaaagtgtaaaaagataaagatatatataaatattaaatttaatgtatattttaaatttttgtataattagtttacgtttgtagtttatgattggaatttttttaatttttaattttgatttttaggtacgtaattttataaaattgtttattttattttttttaaaatgagaaagtgattgtaaattgtaaagaatatgtttttgtttttttaatttaaaaatttagagttttagatattttggttttatattaaagaattgggagatgtgaaatgaattgcgttttatattgatttttaaagtaaataagaagaaaaaggaaaaaaaagttaagaatggtaggtaagataaaagaattgttaaattttatttttaatttgaaattttggatttcgtatatataaaattaagatttttttatattttattttttaatagaaaatattttgtaaaggagagaaaatttcgaagagtggaaagtagaggaaatatagtaagtatagtaaagagaaaggattcgaaatttatttgttaagaataaaaaaaatgaaatttaaattgtataggagtttttatatataaatgtattggtattttttaaattaaattgtatgagagtaataatataggttatttttatatagtatttatttacgagttttaattttagaatatatatcgatatgatatagtgttgtaattaatgtattaggaggtaaagaaaatggttgggttattggacgttttcgattagtttatttaaatatttttaaaattaattaaggggtagggaattagagagagaggaagaaaaaaaaaatggaagaataaaggcgtatcgagtagaaaagattaaagggaacgtggaaggtcggggttgtcgaaattaatttgtgttatcgttggcggacgtcgagagggtcggagatgagagtttaggtcgtttggttgaaggcggtttcggttttattatattttcggttatttttaattttttcggagatataagcgaggaaaattagaatttttaggaaatttttttttcggttcggggttttcgcgtcgtatttaggggtgggttggggggtttcgacggtattcgagggggtgggggaagttttttttttttttcgtcgggtcgtagtggttggagagggatgcggattcgatagaaaaggtaagggtaagtgcgaggggtcgggtttgggtttaagttcggaggagggtataagagtataaattcgtcgagcgcgttcgttgcggcgaattttcgagaattcgcggttttagaggcgtagttttcggttcgttacggtcggtttttgtttagtcgaggtttttcggagtttcgtcgtcgttattaattttttttttttcggcgttgttttttttttttttatcgttataaggaggcgggggcgaaaaggggggagaggaggaggcgataagagatatttattttttttcggtgttttttttcgggtttgcgtttttatttttcgaattttttttttgtcgtcgcgtttcgcgtcgtcgtcgtcgtatcggtttttaatggtcgtagagaattcgttcgagtcgagagttaggttggcgtcgtcgttttatatcgcgcggcggtcggcggaggcgcggtaaggacgtcgggagcggagttggtcggattagagggtcgagggggtcgggtcgagtagcgtcgttcgtacgttcgcgtcgacgcggagtttatcgaggaggtttcgtttcggcggcggcgtaggcggttttttttcgcgtcgcgtttttttttttcgtttttttttttcgcggaaaataaataaatacggtcgttgttacggtttttatcgtcggcggttaggtgttgggagcgttcgtttttcggggtttcgttcggggtcgttcgcggcggcgggagaagacgtcgcggggcgcggggttatgtaatggttttttttaggcgtcgacgtcggttcggttgttggatcgcggtgggggtgtgtgcggacgggagggggttgggggtcgttttagttcgtgcgtttcgggttttttgttattgtttcggtttttgtcgttttttttcgattcgattttttttcgtattttttggttttcgtagttagtatttagttcggcgttttgtttgtttattttcgttcgttttttttcgtttttttttttttttagtttagtatataaataagatggcggttgttgttttttttttttgtcgaattttttttataggttagcggtagcggcggcggtcggaaatgagttaagggggggtggaaaaggggagtggtcgggttttcggaggggggcggggtttaggttcgagtcgtttatataatgggggaagtggagtcgggggcggggtttgttttaattacgggattcgttttaggttttaacgcggttagcgttttcgtaaattttttcggcgttattttgtggttttttttaaaggggaggattttaagagtggggaggattttaaggggggaggggcgggggcggatttagaatttatttttagtcggtggatagttacgagggaaggtttttgtttttggtttttgcgtaagggattagtgggaatcgggacgacggaatttcggagttgtttcgaggaaggcgttaagtcgttatttaggtggttaaatgggagcgttcgtagggcggttttgtttttcggtttttgggtggcgggttttttaaaatttcggtcgaatttattaggtagggtgtatttattgtcggttgtttcgggttagatatttagtgcgtttttatttttttattgtttttttaaagggagtagtttatatttaaaaagtacgttgattacgagttgtttttattttttttgaatttttttttttttttttatgtattatttatttatttattttataacgagtattattattttgattagaaaataaaattatagtagtggaaagatgtttcggtattagatttaaatttattttttgttttttacgtgtgtttatacgtttttattaggtagtatttttatcgtagaagtttttaagtatttttttaaatatggttgggatttgaagatatttttagggtttgttttttttttttttttcgttcgtttttaatagaataagttagtaaaagattacgtttagttattgttttatttaatgtaattatgggaaaaataaaaatgtggtaaaggtaatgtaaggatggaaaaaagtaaaaatgtaatggtgagaggaaatgttggaatataaagtttagtgtgtgggattttatagttttgtagttgaggtcggagacgtgtttttaggtttttatatattattttgtgtttggttatgggtaaattggtattggaggaggtggtaggggtgtaagtgatttcgaaagaaatttcgaaattagtatttattgatacggttaaaagttttttttcggttaggtacggtggtttacgtttgtaattttagtattttgtgaggtcgaggttagtggattatttgaggttaggagttcgagataagtttggttaatatggtgaaatttcgtttttattaaaaatataaaatttgttcgggtgtggtggtgtacgtttgtaattttagttatttgggaggttgaggtaggagaattttttaaattcgggaagcggaggttgtagtgagttgagattgtgttattgtattttagtttgggcgataagagtaaaattttgttttaaagaaaaaaaaatttttttttttttattttatattttatgtttcgtagttggtatttgtaaattgttggattttttttgtttttttttttatattgtttttgtttgttttttaaattaatgttgggatgaataaataagaatataagagtgaagattttaatggagtaattgaagttgttgatagggatggaatttgttttttaatgattaggtttagattatttaaattgtagtagaaaagtaggtaaattgaatcgggcgtggtggtttacgtttgtaattttagtattttgggaggtcgaggagggcggattaggaggttaggagattgagattattttggttaatacggtgaaatttcgtttttattaaaaatatatataaaaaaattagttgggcgtggtggcgggtatttgtagttttagttattcgggaggttgaggtaggagaatggcgtgaatttgggaggtagagtttgtagtgagtagagatcgtttattgtattttagtttgtgcgatagagcgagattttgttttaaaaaaaaaaaaaaaggttaggtgcggtggtttacgtttgtaattttagtattttgggaggttaaggcgggcggattacgaggttaggagatcgagattattttggttaatacggtgaaatttcgtttttattaaaaatataaaaaattagtcgggtacggtggcgggtatttgtagttttagttattcgggaggttgaggtaggagaatggcgtgaattcgggaggtggagtttgtagtgagtcgagatcgcgttattgtattttggtttgggcgaaagagcgagatttcgttttaaaaaaaaaaaaaaagtaggtaaattgaaaaggatagaatttttttattttaaagttgttataggatgaatttaatgtgtaggagtgagattaagattggtttttagggataattttgttatttttaatagtttatatttatatttagattaaggagtataaaggaaagaatgttggtcgggtatagtgttttatgtttgtaattttaacgttttaggagacgagggtgggaggatcgtttgagtttagtaaatataaagagatttttttattttttatttttataaaagttaaaaaaaaaaaattatttaggcgcggtggtgtatatagtatttgtagtttagttattttagatattgaaatgggagaattattttagtttgggaagtcgaggttgtagtgaggtgtaattatgttattgtattatagtttgggtaatagagtgagagattttgttttttaaaataaataaataaatattttaaaaaataaagtaaagaaatgagaaatgtggaggatatttggaaatttgttttgttattttttggtgggagattgtttgtttagttttttttttttgtttttttttttgagacggagtttggttttgttgttaggttggagtgtaatggcgttattttagtttattgtaatttttgttttttgggtttaagtgatttttttgttttagtttttcgagtagttgggattataggtgtgcgttattatatttagttaatttttgtatttttagtagagatggggttttattattttggttaggatggtttagatttgttgatttcgtgatttgttcgttttggttttttaaagtgttgggatgataggcgtgagttattgtattcggtttgtttttgtttgtttgtttttttgtttttttgagatagagttttgttttgttatttaagttgtagtgtagtggtatgattttcgtttattgtaatttttgttttttaggtttaagtgattttttcgttttagtttttttggtagttgggattataggtatgtattattacggatttagttaattttgtgtatttttagtagagacggggttttattatgttaggttggttttaaattttttattttagttgatttatatattttggttttttaaagtgttgttataggaatgagttattgtatttggttttagttggtttttttttttttaagagtttttttttttttttatgagatagagttttattttgttgtttaggttggagtgtagtggtatgattttggtttattgtagtttttgttttttaggtttaagtaatttttttgatttagtttttttagtatttttagtagtagggattatagatatgagttatcgagtttggtttttttttttttttttttttttttttttttttttttttttgagatagagtttcgttttgttatttaggttggagtgtagtggtgcgatttcgggttattgtaattttcgtttattaggtttaagtaattttgttgttttagtttttcgaatagtttggattataggtttgcgttattacgttggttaattttttgtatttttagtagagatggggttttattatgttgattgggttggtttcgaatttttgatttcgtgattcgtttgttttggatttttaaagtgttgggattataggcgtgagttatcgtatttagtttttttttttttttttttaaagagtttttgtaaattttaggaaaaagatttgtttagttttatataggatttagtttgaattaaagtagtatttaaatatattttgtttatttggttaaaaatattgtaggattagatataagaagtggattgaaggagatttgaggaatattttatgagaaaatttaattaaaagaaattagaggttatggttttcggttttgttgtatatgtagaattttgatgtttggggtatttttttgagatgtgtttttttggtttttttttaggattttgaatttgaaattggttatgttggaagtggttgatggtaagaaaatatggattatataaagataattaaggtgatttttaagatggttttagaatagtagaattgaagttgggtatggtggtttacgtatgtaatgttagtattttggaagttgaggcgggtagattattagaggttaggagtttgagattagtttggtttatatagtaaaatttcgtttttattaaaaatataaaaaagttagttggatatggtggtatatatttgtaattttagttatttcggaggttaaggtataagaattgtttgaatttaggaggtggaggttgtagtgagttgagagattatattattgtattttaatttgggcgatagagtaagattttgttttaaaaaaaagaaaagaaaaatagattacgtttgtaattttagtattgtgggaagttaaggtaggtggattatttgaggttaggagtttaagataagtttggttaagatggtgaaattttgtttttattaaaaatataaaaattaggttcggagcggtggtttatatttgtaattttagtattttgggaggtcgcggtgggcggattacgaggttaggagatcgagattattttggttaatacggtgaaattt

SEQ ID NO: 49 - DNA, 6815 bp, Artificial Sequence
  chemically treated genomic DNA (Homo sapiens)
ttgtttgcgaattaaaaatttagagtttttttgtgaattatgttgttaagaattgtagatttaagttttaagattgtacgaatttaaattttgattttatggttttagttggtatgaagatataaagataattttttagtaaaaatagttttgaaagatcgggcgtgatggtttatgtttataattttagtattttgggaggttgaggcgggtggattatttgtggttaggagtttaggattagtttggttaatatggtgaaattttgttttaattaaatatataaaaaaattagttgggtgtggtggcggatatttgtaattttagttatttagggaggttgaggtaggagaatcgtttgaatttaggaggtagaggttgtagtgagtcgagattatattagtgtattttagtttgggtgataaaagtgaaattttgttttaaaaaaaaaaaaaaatggtagaatgttatatggaaagttaatttttagagatagtaatttagatatttataatattatattgtttttttaagtatttatattaataaattaattaatatttgttgatttaatatggttagggatagtgttgggtttttataatttttaagtaattttagttagattttgtttttaaggagtttatgagtagtatgaggagataaaaaatagataaataattttaatttaggaagaatttgataaatgtatgataattattattagaatttagaggagaggaaattttttttgaatagagattaaaggaaggaataatgaatgtggtagtatttgggttggatttattataagaggtatgtttttttttgataagttaagaaagtggggatttaaggtagaagaaaagaaaagttttgagtttttggagtattaaaattttgtttggttgaagtataggttatagtcggaggagatggattaggaaggatcgttatgggtagagaggaagttttgaatttatgggggaagttatgatttgggttaaagatagagttgggttatgttaagatggattttgaagtagtaaaaaaaaatttaagaaagtaaataggttgtagggtttaggatgaagttcgggaggaaagggtagagtggtttttaggaggtcgttaggataggtaaggtaatgggttttaaagggagtggtcgaaatgtaatggaaaaagagagattgtaaagttagaaggtttaggaattgttttttgattaggtgtggaaggtaagggaaaattagttttcgaagaagatagtgagattttaatttgggtggttggagagatagtgatgttgggtatagatacggggaagttgagaggaatattatgtttgagaatggtgatttatatttgaataagtttgtaatgtttagtagatcgttggaaaagtggggttggagatatatttaacggaggagttagattaatttttatttttttttatttgagagagttagtaagttacggttggaacgtgtgtgtttagtaggagagggtagggagggaagttaagagagttgggagttcgagtgaagtttttgttaaaggtagaagaggaaagtcggcgtagtatagtatatttttttatttatgtttattaagtttagggataaggtttattaagatgagtttggaagagaatgttggagagaaagtggttaagaaaattgtttttattgaattttttgggttaattttgattgtaagtttttgaataattaaagtttgtgaggagatagttaatttttttattttttttatgttaatagtgaataattgtagatttttttttttttttttttttttttttttgttttttttttttttttttttgaatatttttgtttttttttgggattggtttagagtatgggtggttattgttgatttataggaggtattattgttattaataaagggtaatagtttttttttttaatatttatttatatttagtatttatttttaatattgattatggagagagtttttttgtgtttaaatattgtaatattgggggttttttaaagtataaaaatatatatttgtatgatggtattattaatatttttatggttttttattttttttttgtattggttttaagagttatttataaattttttagtaattgtatagtgttttagggttagagatcggttatttttggtattgtgattagagttatttaatatttaaggtggtgattaatgtttggtaataaagtttttattgggtgttatgtgttttgggattttgagcgtgggtattttaggagtattttagtattgcgtgttagtattatggtcgagagaatagttgagaaagtggttaagaggtggatttatgtgaacgttattgggaaatgagagatttcgtttttaattacggttagtgtaattcgaaagtttaaaattagtttaaaataaaggtatttatttttattttatgtttatattttaggtttttaataatacgtattttttatatgtttatagaaagtagttaattgagttatttatggaaaggtttgtgggtttggttaacgaagtggaggagtattatattttagttggaaatatatttttagaatgttaaaatatttattttaaagtttggttttttggtgtaatcggaggtatggtaatgtttttgtttagagattgggggttagggttagtaaggtatttgatttatatgtattttagaaggtttttattgttaaattatattttttcggaaaaattatttatgttttattttgtaaatttgatatttatatatttttgattggtattttattttagtcgtaagattatgatttatagtaagtttgtttttttttttgtttggggtggtagtagaaagtatagggtattttttagtttttaagggtaggggtaaaggggttggggttttttttttttagtatagttttttttggttgtgttatattgttttttgtgagtagatagtaagtttttttttattttttattgttatttatttagcgttgtgtagtagtttagttgcgtgtttgtcgggaggggttgttaagtgttttgtttattggttgtttttcgaatttttgttattttacgtataaatatatttatatattttttttgtttagtttatatattgagttattcgtatatgcgagtatatttttttttttttttttattttttcggtttttgatttttataagtttatggaatatttttggaaagacgtttttgatttagtagggtaggtttgttttgatttttttttttgtagttttagtattttgagaaagtaatttatttttttggttagtgtttgtattttagtagggagatgaggattgttgttttttatgggggtatgtgtgtgtttttttttttttttaggatttgtaggattttttgtgttatttgtatataatttggtaggtttatattttttaagagttttatgaagtgttttttgtatgtgttttaaaaaggtatttgaaaattgaaagtgtgatttatggaaattaaattatttgtaaaaaattgttttggaaagtaatgattgttggttataaagggaaatatttgcgatgtatttaatgtgtttttaattttttatttgttgataatttatagttattaatgttaaattcgattttggttttagttatatttgtatattgtttaataatggtttatttttgtaagaattagataaaatgtatatttgatataaaatagttaaaaatgtaatttttagtaatagtaagtttggtatttagatagattatgaatatttcgttagatattttgttgggtgtttgggatagtaattaaaataaagtattgatagttgtattagagtttattaggttgtagtaaaggaagtttatttaaaagtataaattatttaagattatagacgtatgatatattttatttattttttgtttttttaatatgtatatatatatatatatatatatatatatatatatatgtgtgtgtgtatgtgcgtgtgtatgtttaatttttaatttagttaaaaatttttttttatttgttttttatttggatatttgattttgtatattttagtttaagtgaatcgagaagatcgagttgtaggattaaaggatagatatgtagaaatgtattttaaaaatttgttagttggattagatcgataatgtaatataattgttaaagttttggttcgtgatttgaggttatgtttggtatgaaaaggttatattttatatttagttttttgaagttttggttgtataattaatttgtggaaggtatgaatatttatgtgcgttttaattaaaggtttttttgaattattttttatatgagaatttttaatgggattaagtatagtattgtggtttaatataaatatataagttaggttgagagaattttagaaggttgtggaagggtttatttattttgggagtattttgtagaggaagaaattgaggttttggtaggttgtatttttttgatggtaaaatgtagttttttttatatgtatattttgaattttcgtttttttttttttagatgttttttgttagtttttttagttgttaaatatagttgtttgtggttggttgcgtatgtaatcgtatattttattttatttgttttatttcggttatagtgtagttttttttagggttattttatgtatatattacgtatttttagttaacgaggagggggaattaaatagaaagagagataaatagagatatatcggagtttggtacggggtatataaggtagtatattagagaaagtcggtttttggattcgtttttcgcgtttattttaagtttagttttttttgggttatttttagtagattttcgtgcgttttcgttttttggtcgtgaaatttagtttttatttagtagcgacgataagtaaagtaaagtttagggaagttgttttttgggatcgttttaaatcgagttgtgtttggagtgatgtttaagttaatgttagggtaaggtaatagtttttggtcgttttttagtatttttgtaatgtatatgagttcgggagattagtatttaaagttggaggttcgggagtttaggagttggcggagggcgttcgttttgggattgtatttgttttcgtcgggtcgttcggttttatcggattcgtaggttttcggggtagggtcggggttagagttcgcgtgtcggcgggatatgcgttgcgtcgtttttaatttcgggttgtgttttttttttaggtggttcgtcggtttttgagttttttgttttgcggggatacggtttgtattttgttcgcggttacggattatgattatgattttttatattaaagtatttgggatggttttattgtattagatttaagggaacgagttggagtttttgaatcgttcgtagtttaagatttttttggagcggtttttgggcgaggtgtatttggatagtagtaagttcgtcgtgtataattatttcgagggcgtcgtttacgagtttaacgtcgcggtcgtcgttaacgcgtaggtttacggttagatcggttttttttacggtttcgggtttgaggttgcggcgttcggttttaacggtttggggggtttttttttatttaatagcgtgttttcgagttcgttgatgttattgtattcgtcgtcgtagttgtcgttttttttgtagttttacggttagtaggtgttttattatttggagaacgagtttagcggttatacggtgcgcgaggtcggttcgtcggtattttataggtattcgcgttcgcgtcgttcgtcggggtggtcgtcgcgttcggtaggagggagggagggagggagggagaagggagagtttagggagttgcgggagtcgcgggacgcgcgattcgagggtgcgcgtagggagttcggggcgcgcggtttagttcgggggttttgcgtgtagttcgcgttgcgtttagagttaagttttttcgtcgggtagttgaaaaaaacgtattttttatttatttatcgttcgtgcgagaggtagattcgaaagttcgggttttttaataaaatatacgttggaaaattagataaagtagtagttatttgtgggggaaaatatttttaggtaaataaatacggggcgttttgagttatttgggaaggtttcgtttttggtatttaaagttgggggtgtttggagttagtagagtttagtagagttttatttatttttttaatgtttttgtttaatgtgttttttaaatttttttttatttagattatttgattggaaatatgttagttatgatgatgattttttgggaagcgatttttgttattcgttttttttttttttttattttacgttttggggttttagagagcgattgggagttgaatgggtttgatttcggagttagttggttgagttcgcgttggagcggattgttggtatgtgatttttgatagtcggaaatttgtaggtgtttcgcgagtttaaaataagttatatggaagtataagtgtttaaaaataattttttgttagtttagtgataagtttgttttattcggggagaatgtttcggagtggcgtgcgggttagttagggtttgcgtttcgtagttattgtggaaggagcgcggtcggtttaggatataggagattattttgtgattttaatggcgaaggttgtgtgtttttattttaatttttttttttataagaattgttttttttttttttttttttttttttatttttttttgtttagttttttttttt

SEQ ID NO: 50 - DNA, 6815 bp, Artificial Sequence
  chemically treated genomic DNA (Homo sapiens)
aaaaggagaaattgggtaagagaaaatgggagggagaggagagggagaaagaataatttttgtagggaaaaaaattaaaatgaggatatataattttcgttattgaagttataaagtggttttttgtgttttggatcggtcgcgttttttttatagtggttgcgaggcgtagattttggttgattcgtacgttatttcggggtatttttttcgggtgggataggtttgttattgggttggtaggagattatttttaagtatttgtgtttttatatggtttgttttaaattcgcgggatatttataaattttcggttgttagaagttatatgttagtaattcgttttagcgcggatttagttagttaatttcgaaattagatttatttaatttttaatcgttttttaaagttttaggacgtggggtggggaggaggggaaagcgggtgataggaatcgttttttagaaagttattattatagttgatatatttttaattaaatagtttagatgaaaggaaatttggggagtatattaaataaaaatattaaaaggataaataaaattttgttgagttttgttaattttaaatatttttaattttaaatgttaagagcgagatttttttaagtgatttaaagcgtttcgtgtttatttgtttggaggtgtttttttttataaataattgttgttttgtttggttttttaacgtgtgttttgttaggaagttcgggttttcgggtttgtttttcgtacggacggtaagtgggtggagagtacgttttttttagttgttcggcgagagaatttgattttgaacgtagcgcgggttgtacgtagaattttcgggttgggtcgcgcgtttcgggttttttgcgcgtattttcgggtcgcgcgtttcgcggttttcgtagttttttaggttttttttttttttttttttttttttttttttttgtcgggcgcggcggttatttcgacgggcggcgcgggcgcgggtatttgtagaatgtcggcgggtcggtttcgcgtatcgtgtagtcgttgggttcgttttttaggtagtagggtatttgttggtcgtggggttgtaggaaaggcgatagttgcggcggcgggtgtagtagtattagcgggttcggagatacgttgttgagtggggggaaattttttaggtcgttggagtcgaacgtcgtagttttagattcggggtcgtaggggaggtcggtttgatcgtagatttgcgcgttggcggcggtcgcggcgttgaattcgtaggcggcgttttcggggtagttgtatacggcgggtttgttgttgtttaggtatatttcgtttaggggtcgttttagggggattttgagttgcggacggtttaggggttttagttcgtttttttggatttgatgtagtagggttattttagatgttttggtgtggagggttatggttatggttcgtggtcgcgggtagggtgtagatcgtgttttcgtagggtagaaggtttagaaatcggcgggttatttggaaaaagagtatagttcgaggttagaggcgacgtagcgtatgtttcgtcgatacgcgagttttggtttcggttttgtttcgggagtttgcgggttcggtgaagtcgggcgattcgacgggagtaagtgtagttttaggacgaacgtttttcgttagtttttgggttttcgggtttttaattttaagtattggtttttcgagtttatatgtattataaaggtgttggaggacggttagggattgttgttttgttttgatattggtttaaatattattttaggtataattcgatttggagcgattttaaagagtagtttttttgaattttattttatttgtcgtcgttgttggatagaggttgagttttacggttagggggcgggggcgtacgaggatttgttaaaggtggtttagggaagattgggtttaaaataaacgcgaaagacggatttaggggtcggttttttttaatgtgttgttttatgtgtttcgtgttagatttcgatatatttttgtttgtttttttttttgtttgatttttttttttcgttggttagaaatacgtagtgtgtatataggatgattttggggaggattatattgtaatcgagatagggtagatagaatggggtgtgcggttgtatacgtagttagttatagatagttatatttagtagttgggggaattgatagggggtatttgaggggaagggggcggagatttagggtatatatataggaagagttgtattttgttattaggagaatgtaatttgttaggattttagtttttttttttgtaaaatgtttttaaagtagatagatttttttataattttttgagatttttttagtttgatttgtgtgtttatgttggattatagtattgtatttggttttattaggaatttttatgtgaaggatgatttagaaaaatttttggttagggcgtatatgggtgtttatgttttttataggttggttatgtaattaaaattttagaaaattgaatataaaatgtgatttttttatattaaatataattttaggttacgaattaaagttttggtaattatgttatattgtcggtttggtttagttaatagatttttaaaatgtatttttgtatgtttattttttagttttataattcgattttttcggtttatttgggttaggatatgtagaattaaatatttagatgaaaaataaatagaaaaaagtttttaattgaattaaaagttaaatatgtatacgtatatatatatatatatatatgtgtatatatatatatatatatatatatatatatattaaggagataaaaaataggtgaagtatattatgcgtttataattttggatagtttatatttttgaataaattttttttgttgtagtttaatagattttgatataattattaatattttgttttaattgttattttaaatatttaatagagtatttgacgaagtgtttatggtttatttaaatgttaagtttattgttattaagagttatatttttgattattttatattaagtatatattttatttaatttttataaaaatagattattgttggataatatgtaaatgtagttgaagttaaaatcgagtttagtattaatgattatagattgttagtaaataaagggttaaaaatatattaggtgtatcgtagatatttttttttatggttagtaattattattttttaaagtaattttttatagatgatttaatttttataaattatatttttaatttttaaatgtttttttaaaatatatgtaaaaagtattttatagggtttttaaaaaatgtgaatttgttaaattatatgtaaatggtataaagaattttataagttttgaaagaaaaaggagatatatatatatttttatggagaatagtaatttttatttttttgttaggatatagatattagttagaaaggtaagttgtttttttaaaatgttaaagttatagagagagaaattaaaataagtttattttgttggattaagaacgtttttttagaaatgttttatgggtttgtagaagttaagggtcgagagagtgagaaggaaggaaggaatgtgttcgtatgtgcgagtggtttagtgtgtgaattaggtagagagagtgtgtggatgtgtttgtgcgtggaatggtagggattcgggaagtagttagtaggtagggtatttggtagtttttttcggtagatacgtagttgggttattgtatagcgttggatgaatggtagtggggagtgaggggagatttgttgtttgtttatagggagtagtgtggtatagttagagaaagttgtattggggaggagaaattttagtttttttgtttttatttttggaggttggaaagtattttatgttttttgttgttattttaagtaagaggaaaaataggtttgttgtgaattatagttttacggttaaaatagaatgttagttaaaagtgtatggatattaagtttataaaataggatatgggtggttttttcgaaagaatataatttaataataaaagttttttgggatatatgtggattaaatgttttattggttttagtttttagtttttgaatagaggtattgttatgttttcgattgtattaggaaattagattttggaataaatgttttggtattttagggatgtgtttttagttgaaatgtaatatttttttatttcgttaattaaatttataaatttttttatgaatagtttagttgattgttttttgtaaatatgtgaaaaatacgtattattaaaagtttaggatatgaatataagataaaggtagatatttttgttttaaattgattttaggttttcgagttgtattgatcgtgattgggaacgaggttttttattttttagtggcgtttatatggatttattttttgattatttttttaattattttttcggttatagtattaatacgtaatattgaggtgtttttagagtgtttacgtttagggttttaggatatatgatatttaatggaggttttgttgttagatattagttattattttggatattaaatgattttaattataatgttaggagtggtcggtttttggttttgggatattatgtagttattgagagatttatgagtggtttttgagattagtataaaaaagaaatagaaagttataaaaatgttaatgatgttattatgtaaatatatgtttttgtgttttgaaagatttttagtattgtagtgtttgagtataggagagttttttttatagttagtattgaaaataaatattggatataaataaatattgaaaagaaagattgttattttttgttggtgatagtggtgttttttgtaggttaataatggttatttatgttttagattagttttagaaaaaagtaagagtatttagggagggaggagagaggaataggggaaaggagaaggaaaggaaaggggatttgtaattgtttattattgatataggaagaataagaaggttagttgtttttttataggttttgattgtttagagatttataattaaagttagtttaagaagtttagtaaaggtagtttttttaattattttttttttagtatttttttttaaatttattttggtgagttttgtttttgggtttggtgagtatgggtgggaaagtatattgtgttacgtcgattttttttttttgtttttggtaaaaattttattcgggtttttagtttttttggtttttttttttatttttttttgttggatatatacgttttagtcgtgatttattggtttttttaggtgaagaagggtaaagattgatttggttttttcgttgaatgtgtttttagttttatttttttagcggtttgttgggtattgtaggtttgtttaaatatgagttattatttttaaatatggtgttttttttaattttttcgtgtttgtgtttagtattattgtttttttagttatttagattaaaattttattgtttttttcgagggttgatttttttttgttttttatatttaattaagaggtaatttttaagttttttagttttataatttttttttttttattgtatttcggttattttttttgagatttattattttatttgttttaacggttttttaaggattattttgtttttttttttcggattttattttaaattttgtaatttgtttatttttttggatttttttttattgttttaggatttattttgatatgatttagttttgtttttaatttaaattatagttttttttatgagtttagggttttttttttgtttataacgattttttttagtttatttttttcgattgtaatttatgttttagttaagtaaaattttaatattttaagaatttaaggtttttttttttttttattttaaatttttatttttttggtttgttaggggaaagtatgttttttgtaataggtttagtttaaatgttattatatttattatttttttttttagtttttatttaaagaaaatttttttttttttgaattttagtagtagttattatgtatttattaaattttttttgaattagagttatttatttgttttttatttttttatgttgtttataagttttttgaggataaggtttggttagaattatttgggaattatgagaatttagtattgtttttggttatgttaagttaataaatgttggttaatttattgatatagatatttaaaaggataatgtaatattataggtgtttggattattatttttaaaagttaattttttatgtgatattttattatttttttttttttttgagatagagttttatttttgttatttaggttggagtatattggtgtgatttcggtttattgtaatttttgttttttgggtttaagcgatttttttgttttagtttttttaagtagttgggattataggtgttcgttattatatttagttaatttttttgtatgtttagttgagataggattttattatgttggttaggttggttttgaatttttgattataggtgatttattcgttttaattttttaaagtgttgggattataggtatgagttattacgttcggttttttaaaattgtttttgttagaagattatttttgtatttttatgttaattgaggttataaagttaaaatttaaattcgtataattttgaggtttaagtttgtaatttttggtagtatgatttataagagagttttgaatttttagttcgtaagtag

SEQ ID NO: 51 - DNA, 9539 bp, Artificial Sequence
  chemically treated genomic DNA (Homo sapiens)
atgtggtatttttttttttttttattttttgagatagggttttattttgttgtttaggttggagtgtagtggtgtaattatggtttattgtagttttaatttgttgatttttttatttgagttttttaagtagttgggattataggtatgtattattatattcggttaattttttttttttgtagatacgtgtttttgttacgttgtttaggttggtttcgaatttttgggtttaagtaatttatttattttaattttttaaagtgttgagattataggtgtgagttatcgtattttagttataatgtagtaggtatttttatataaaggaatattatttagttatgaaaatgaatgaagtattgatatatgttataatatgaatgaattttaaaaaatttatgtgaagtaaaagaaggtagttataaaaggttatatattatatgattgtatttatatgaaatgtttaaaatagataaatttatagagataaagagatttgtgatggttcggggatgggaggagagggaaatggaatgggagggtgtatgttaatagatatagggttttttttgggggtgatgaaaatgttttggaattaggtagtggatagttatataatttcgtgatatattaatcgttttgttatatattttaagagtgaattttatggttaagagtaaattttatggtatgtgaattatgttttaataaatagaaaaagaaaaaaaagaatgaattattgatatatacgataatgtggaagaatgttatagatattatgttgagtaaaagtagtatatattgtatgatgtgtttttatttttatgaagtgtaaaaataggttaaaaaaattttaggtattatatggtgtttatgggtattaatatatggagtgatggagtaaaaatatttatgaggaagataaatattaagtttaaggtagtagaaggagagagggaaatggaattagtataagagtatttgtaatatcgtatattttttaaaaataatttgaagttaataaggtaaaatattaatgtttgataaaagtagatgtttgttatagtattttttatattttttattttttaaaatagttaattaatagtttgtttttgagggtaaacgtttgattttttaattaggttttggttgatatttgttttggtgtttttgatattatagtttgttaggttttgtttttattttgatgggttttatagtatagaagaggtataaatagtataaatgttatggggtttggattaagtaggggttttagaattttagaagatgttaggagggagtgagttagttagggaaggttttcgagaagagaggatattgaagaagagttttaaatttaggtttgacggagaagacgcgcggttaggatattttattttcgttttcgttttttttaaagtttgatttggttttattgatttttttatttgtttatttttagttgtttttttgttggttgaattgtcgtcgtagatttttgagtttgcgttttttttacggggatgggggagggaatggggtgaggtttggttttatagtttcggggtttttagtttttgttggaggtagggttttggggcgttttattttttatttttggtttttttttttgagcgttttgtgttttttagaaatgaagaaatggggtgagtttagcggttaaatttttgttttagtttttagatatgtttcgagtttgttattttttgtgaggatagatttttttatgttgcgatcgttgtttttaataataataatgatgatgataatttttatttatagagtatattatttatggtgtgttagtaggttttgtgttgagtggtttttatttacgtggggggttaggattttattcgttttttagatgaagaaattgaggtttagagggcgtttggtttaggaattatatagtaaattatatagtaaattagagttgagataagaatttagggttttggaggaatatttttatttttatatatttatgtagaattagtttggaggtgagggtaattatatatatttgtattataaggagttggtgagaatgcgatagaattatgggtggagagcgtttagtatagtgtttggggttatttagtaaataatgtcgttgttgttattattagtttattaatgttattattaatattagaattaaataagtttcggtaatatagcgagattttatttttattgaaaaaaaattttttgttgggtgtggtggtatgtatttgaagttttagttttttaggaggttgaggtgggaggattatttgagtttaggaggtggaggttgtagtgagttaagattgttattgtattttagtttgagtgatatagtgagatattgtttttaaaaaatatttagtacgtattattattattattgttgttagaattagaatagttttagaattagtgttagtattaataatagtattagtgttagattaaaattagtattagtattagatgagtattattatgaaaattagtatgtttttatagaagtagagagtagaatagtggttattagtagatgggagggtaggaggtagggagggatggggagaggttgttaatgggtataaagttatagttagataggaggtataagttttggtgttttaatgtatagtataatgattagagttaataataaatgtatattttaaaatagttgaaagaggcgttttcgaatgtttttattataaagaaaagataaatgtttaaggtgatgaatatgttaattattttgatttgattattatataatgtatatatgtaataaaatattatgttttattttatatatatgtataattattatgtgttaattataaatttaaagaaataaaattagttttagtgttagtattaatattataatattggtattatttttagtgttagtatattattagtattagtattataagtagtagtagggttagaaagggttatgtatttttttttgtatgtagtaggtatttaataaataaataggggtatttaatatttattgagattttagatttaagtaagttaagattatgtaatatgggttaaaatttatttagtttttttagttattgtatggagtggtttattggggtatattattattttatttttatagatgaggagttaaattttagaggggatggtaatttttttaaggttatttgatttattagtggttagggtagtttatgaacgaggatgagttggttttagagattattttttgaaattattgttatttaagttagaggtgtttttgtattcgttttttttattattgatgagggtttagtatggggcgtggtatattagtaggagtttaataaataggaatttatgggtttgtttttttttttttttaaattttttattgtatatgaggatattgaggtttagaggagtgagataagaatggtaagatttttttagggtgggttagtgggtaagttgattttattgatttggggttttatttttggtttttgttttttgtaggttttagtttttttatttgtagattaggtgggtaggatagttttttgttttacgtgtgtatgtgtgttagatgtttttatatagaaaaagtgtttaggttaggtataagtttatgtgaggtttatgagatattgtggttgttgttattaatatttggaggaggtggggtagggtaagagtgtggggattggggtgcggaggtttagttatattttggttgttttttgttgagggttgagggtagagttataggttatattaatttatatttttttattttatttgtatgggtattatatgtttagggtgtgatttagtttgtttggatttttttttgagtttgtttttgaatatttttttgtttttgtttttttttttagttttttatttttgtttttggttttttttttttttaggttttatttgttatttttgtttatttttgttttttattttttttttgtttttttttatatgtttttaatggtttttggtttttttcgggtgtttcgttttttttgttttttttttttttttgtgttttttttttgtttttttttacgtttgtttttttttttatttatttttgttattttttttttttttatttttattttttttcgtttatttttgtttttgtttgtttttttgtttttgttttttttattttatttttttttttttttattttattttatttttcgaggaattatttttggtttttattttagtttttcgtttttaaggtagtatggcgggtaagaagttgaggttattgtttttgggtgtttttatttttatatttttattttaagatagtttgttattgcggcgttaatagttacggtcgtttatatttgataagatttatttgttgttttagggtaggtcggagttggcgtaagttttagtggggcgttaagtgagtgtgtttttgtttttcgttagtattggtttggtttgtaggtttagtttgggttattaaggtattttataggttttagtttaaatttagtagaatttttttgagttttattttttttatttgtaaaatgggtatagttatattttttttttttttgtagttaggaagacgtatatatataggagtttagtttatatcggtttcgtataaattaagggttttattttttgaaaagtttagtgaagttatgaaattatatttgttatttttatttattttggttttagtttattttgtttgtttggatattatagtttacgggagtttaggtcgagcgaggtttaagaatttttagggtgggtagggagggtggaagagggtttttagtgtttaagaggtgttttataagtatgggattcgtttttttttttggattgttttatttattggggtattagttattttttggggaggagggaggagggagaagggagggagggagggagggaggaagggagttttaaaggttaaggttagttaggatattttttgggattatattgagtttgttatatttttaaggcggtcgaatttttcgtaattattagtttaggttagttttagtttttagagagtttttattaaggtaattttgggtttgttgtttttatttttatgtttgttttaggttttttaatttatagttggtttttaaagtgttagttagttttgaatttttttatagtttttttaatttatttgtttttttaatttttatttttattttaaatttattttttaaattttatttttttttgtttttttatttatttcgtttaagatatttatattttttggatttttttattttgttcgttatatttttaggtttgttttttttaaatattaattttgttttttaaaatatgattttatttttttaaattttttttttgttttatatttgatttttatttatttaaatttgtttttgtttttttgattttttttttaaattttatttttttgtttttaaattttttatttgttttataacgttttgtttttgttttattttttttgagtttttaaatttgtttttgatttgttaaattttagttttatttttttattattatttttgttttttaaatttattttttgtttttaatgatttttttttgattttcgtaaattatttattttttttaattttttgtttgtttagtaaaatatttttgttattttaaatattaagttaattttttaaaatttgttttgtcgtatgaatttttatgtttgttttttttaaatcgtattttagttttaaaatatattttattgtttttttgaatttttttagttttaagtttttttttattttaattttattttggttttttaaatttttttttattagttatattttgtttgtttaaatagatttttgatttttaaattttattttttttttagaaaaatttttgaattttttagatttttttatgatttttagaatttgatttttatattattttttaattttatttttgatttttaaatttcgtttcgattttttaatttcgtttgtttttataatttatttttgagtttaaaatgtgtttttgaatttttaagttcgtttttgttttataatttcgtttatatttgtttttttataaattttatggttatattttaaatttttttgatttaattttatatttgatttttaaattttatttttatttttttttaagttttatatttgttttttagattttatatttgttttttttagttcggtgagatttttttttgagggttgggattggaacgttatttggggtgaggggttggggtcgagggagagtggagggtgttagttgttgtttgttgtcgtcgttggggtaatatttattttagtggggtagttgataaggagtttttatattttttagtttcgagataaattttatttttgttcggagagtgataattgggggtgaggaggttgggtttttgttatgggaggggtgggtagttttggatttattaacgtgtgaggtgtaggggttgggggtagtggggttggagggagattatggtgggtaaggtggagttgaggggatgagggaatagtggtgaaagagtgagtagaagatatataatgagatagggaagagagggagaaatagggagagatgggaagagagagatagagatatagagataaagagtaagagataaaagagatatgaagagaaaggaaaaatagagagagagaaatttaacgagtaagagatagagatagatagatggtcggagaaaaagaaggaaagattcgggagtagaaaaggagatagaaatgtagagatatacgtaggtagtattgtgaagaggtagagattaatatagaattagagatagagaggaaagagatggagattaagatggggaagtaaaatattttttttagagagtaatagtaggtattttggggttgagaaggtgttggcggtgggtatatttgtggtttattttttttttagtataatttttaagtttgggtttgttttttagtttgtttatattatgggttatgtaagtaggagtgaggggtagtttgaagatagttttttagtttagttttgttattttattttatagatatagaaatagagtaggttagtataatagggttagggttagtattttaggttttttattttgagttgtatgtggttgggtacggttaggggtatgggattagtaagaggtacgtggatataaggttagagggtttaaagagagggaaatagagggaatagataaataagtaggaagagtgggagagatgtagagatgtttagagagataggagaggagagggagaaagtaagagtaatagaaagagagagttagagagagaaatatgggaagatagaaaagaagatagaaaattattaaatattataaaagtatagaaagaggtcgggcgtagtggtttacgtttataattttagtattgtgggaggtcgaggtgggtcgattatttgaggttaggagtttaagattagtttggttaatatggtaaaatttcgtttttattaaaaatataaaaattagttgggtgtggtggtatgtgtttgtaattttagttattagggaggttgaggtacgagaattatttgaatttgggaggttggggttgtagtgagttgagatcgtattattgtatattagtttgggtgatagagtgagatttcgttttaaaaaaaaaaaaaaaagaaaaagaaaaagtatagaaggagaagataagttatattatagaaatatagaaagttggggaagttatagagttagatttgagagggaatagagagttaggggaaagagttttaggggatagagaagtggagagttagatgatagatatatataaggtaaaataggtaaagggttattttataggttttagtttagttttagtttattattatttttaatatagtagatggggaaattgaggtttgggaattgaaagagtttgaaagtagaattttggtgggtttttttaggggagagggtatcggtagaggtattttttatttgttattttttttagaggaagttagtggttttggggtgattttaaaagttgggcggggaaggtagagataagtagtggggggtattgatttttttttaattaagaagtagggaggaattaagggggttttttgtttgtagacgtaatagaggtggagggaggagggagttaagttcggaaattatggggtttttgagaaagttagagggtaagatataatagatagggatgaagttggggagtagaggatggtgaattttaaagttttgggtgaagtgattaagaggtaagggattttggttttgtatgttattttatttttatttagatttttttagagggggagggaagaaaggacggggggacggggagaataagaggaagtggaggaggggaggagaggagatggggaaagggagaaaaggatgaatagaaaagggaggagaaggatgaagaaattggaggggaggagaaaatgagtagtaggagaaaggagtggagagtagatgtagataggggaagagaggtcggaagtggtggtttatatttgtaattttagtattttgggaggttgaggtgggaggattatttgaggttaggagtttaagattagtttgggtaatagagttatattttatttttataaaaaaaaaataaaaattagttaggtttggtggtatatatttgtagttttagttatttaggaggttgaggtaggaggattattgtcgggaggtagtggttgtagtgagtcgagatcgtgttattgtattttagtttggtaatagaggagattttgttttaaaaaaaagtgtgtgtggatgggggagagggagataaggtgtgtgagaaaggtagaaaaggagaatgaagataaaaagagaaggaggataaggaagaggggaaataggaaaggagaaggaggaggttaaggaggaaaagaagaaggtggaggagaaaaaggaagtaggagagaatgagaaaagagtggaaagagaaggaaatggggaagaggggggtaaagaagagatgggaagaagagagacgggagaaagataggaggaaaagggaaggggggaagaagagagagaatggaaggaagaagggagaggtagaagtagatgagagtggaggaagagcgagaggagggaggagaggaaagataaacggtaagagggggagaacgaggaggaagatgaaaggaggggtatataggagtggaacggggagatgtaggagggaaaagagaggagagggaggaagagaaggaggggaaggagaggggagattaaggtgaggaggaggggggaatggggaggtgggaaggagaaatatggagattgaggtgatggagtgggaggagggggaaaggagggaagaggagtaggtgaaaggaggtgggggggaaggatttttgtgtttgaggattttttttgttttcgtagg

SEQ ID NO: 52 - DNA, 9539 bp, Artificial Sequence
  chemically treated genomic DNA (Homo sapiens)
tttgcgaggatagaaggggtttttagatatagaaattttttttttttatttttttttatttgtttttttttttttttttttttttttttttattttattattttagtttttatattttttttttttatttttttattttttttttttttttattttagttttttttttttttttttttttttttttttttttttttttttttttttttttttgtattttttcgttttatttttgtgtgtttttttttttattttttttttcgtttttttttttttgtcgtttgttttttttttttttttttttttcgttttttttttatttttatttgtttttatttttttttttttttttttatttttttttttttttttttttttttttttttttttgtttttttttcgttttttttttttttattttttttttgttttttttttttttatttttttttttttttattttttttttatttttttttgtttttttttttttttttatttttttttttttttttttgattttttttttttttttttttgtttttttttttttttgttttttttttttttttgtttttattttttttttttattttttttatatattttattttttttttttttatttatatatatttttttttgaggtagggttttttttgttgttaggttggagtgtagtggtacgatttcggtttattgtaattattgtttttcggtagtgatttttttgttttagttttttgagtagttgggattataggtgtgtgttattaggtttggttagtttttgttttttttttgtagaaatggggtatgattttgttgtttaggttggttttgaatttttggttttaagtgatttttttattttagttttttaaagtattgggattataggtgtgagttattattttcggtttttttttttttgtttatatttattttttattttttttttttattatttattttttttttttttttaatttttttatttttttttttttttttttgtttatttttttttttttttttttatttttttttttttttttttttatttttttttatttttttcgttttttcgtttttttttttttttttttttagaagagtttgggtgagggtgggatggtatgtaggattagagttttttgttttttggttattttatttaggattttggggtttattattttttgttttttaattttatttttatttgttgtattttgttttttaatttttttagaaattttatggttttcgggtttgatttttttttttttttatttttgttgcgtttatagatagaaggtttttttagtttttttttattttttggttgggggggggttagtattttttattgtttatttttgtttttttcgtttaatttttgaaattattttaaggttattgattttttttgaagagggtggtaggtgggaggtatttttatcggtatttttttttttggagaggtttattagagttttgtttttaggtttttttagtttttaggttttagtttttttatttgttgtattgggggtggtgatgggttggggttgagttgagatttgtgggatggttttttgtttgttttgttttgtgtgtgtttgttatttagttttttatttttttattttttggggtttttttttttgattttttgtttttttttaagtttgattttgtagtttttttagttttttgtgtttttatgatatagtttgttttttttttttgtgtttttttttttttttttttttttttttttgagacggagttttattttgttatttaggttggtgtgtagtggtgcgattttagtttattgtaattttagttttttaggtttaagtgattttcgtgttttagtttttttagtagttgggattataggtatatgttattatatttagttaatttttgtatttttagtaaagacgaggttttgttatgttggttaggttggttttgaatttttgattttaagtgatcggtttatttcggttttttatagtgttgaggttataggcgtgagttattgcgttcgatttttttttgtgtttttgtaatgtttgatgattttttgtttttttttttgtttttttatgtttttttttttggttttttttttttgttatttttgttttttttttttttttttttatttttttgaatatttttgtattttttttattttttttgtttgtttgtttgttttttttgtttttttttttttgggttttttgattttatgtttacgtgttttttattagttttatatttttgatcgtatttagttatatgtagtttaggataaggagtttggaatgttggttttggttttattgtgttggtttgttttgtttttgtgtttgtagggtggagtgatagggttagattagaaggttgtttttaaattgttttttatttttgtttatatgatttatggtatagataggttaaggggtaggtttaggtttgggagttatgttaggaaagagatgggttataagtgtgtttatcgttaatatttttttagttttagggtgtttgttgttgttttttgaagagagtgttttgtttttttattttggtttttattttttttttttttgtttttaattttgtgttagtttttgtttttttatagtgttatttgcgtgtatttttgtatttttatttttttttttgttttcgggttttttttttttttttttcggttatttgtttgtttttgttttttattcgttgagtttttttttttttgttttttttttttttttatgttttttttgttttttgttttttgtttttgtgtttttgtttttttttttttatttttttttgttttttttttttttttttgttttattgtgtgttttttgtttatttttttattattatttttttatttttttaattttattttatttattatgatttttttttagttttattgtttttaatttttgtattttatacgttggtgagtttagggttgtttattttttttatggtaggggtttagtttttttatttttagttattatttttcggatagagataaagtttatttcgaggttgggggatatgaaagttttttattagttgttttattagagtaagtgttgttttaacggcggtagtaggtagtagttggtattttttattttttttcggttttagttttttattttaggtaacgttttaattttagtttttaagggagggttttatcgggttgaagggagtagatataaggtttagggggtagatatggggtttagggggagatagaggtggaatttgaaggttagatatggggttaagttagagaggtttggggtgtagttatggagtttgtggggaggtagatatgggcggggttgtggagtagagacgagtttggaagtttagagatatattttgggtttaggaataggttgtgaaaatagacgaggttgggggatcggggcgaagtttgagagttagaaataaagttgagaagtagtgtgggagttagattttgagggttatagaaaagtttggggagtttaagggtttttttggaggagagatggagtttaggagttaaagatttgtttgggtagatagaatgtggttagtaaaggggagtttgagaagttaagatagaattggagtagagaaaggtttggagttggagagatttagggagataatgagatgtgttttagggttgagatacggtttggggaaggtagatatgagggtttatgcggtagaatagattttggggagttgatttggtgtttgaagtgataaagatattttattgagtaggtagggagttgggagagataaatggtttgcggagattagagagaagttattgggaataaagagtgggtttgaaaggtagagatggtggtaagaggatggagttagggtttggtagattagagataggtttgggggtttagagagagtggggtaaagataaggcgttgtagagtagataaggggtttgggagtagaaaagtgaggtttggaggagaagttagggagatagagataagtttgggtgagtggaaattagatatgggatagggaaaggatttggggagataaagttatgttttgggagatagagttagtgtttaggggagatagatttaggggtatagcgagtaaagtgaagggatttagaggatatagatattttggacggagtggatgagagggtagaaagaggtggggtttagggggtagatttggggtagaaatgggagttggaaagataggtgggttggaggagttgtaaagggatttagggttggttgatattttggggattagttgtgggttggggagtttggagtaagtataagggtaggggtagtaggtttagggttgttttggtgggggttttttgggggttgagattgatttgggttggtggttgcggagggttcggtcgttttggggatgtggtaagtttagtgtgattttagggggtgttttggttggttttggtttttgaggtttttttttttttttttttttttttttttttttttttttttttttttttttagggagtggttggtgttttagtgggtggggtagtttaggggagggggcgggttttatgtttgtggggtattttttgggtattggaggtttttttttattttttttgtttattttggggatttttggatttcgttcgatttaggttttcgtggattgtagtgtttagataagtaaaataggttgaaattaagataaatgaaaatagtagatatggttttatgattttattgggttttttagagagtaaagtttttaatttgtgcggggtcggtgtgggttagatttttgtgtatgtgcgtttttttggttgtagggagagaagggatgtggttgtatttattttgtaggtgagaagagtgaggtttagagaggttttgttggatttgaattagagtttgtgggatattttgatgatttaggttaagtttgtaggttaggttagtgttggcgggaggtaggggtatatttatttagcgttttattggggtttacgttagtttcggtttgttttggggtagtagataagttttattagatgtaggcgatcgtggttgttggcgtcgtagtaataggttgttttggggtgagggtgtgggggtaggaatatttagggatagtggttttaattttttgttcgttatgttgttttggaggcgggaaattgaggtgggagttagggatgatttttcgaggagtgggatagggtaggaaaggaaaggggtggagtgggagagatagaggtagagagataaataaaaatagagataggcggagagagatggaaatggggagaaagagagtgatagagatgaatagagaaggagatagacgtggaaagaggtagagagagggtataaaagaaaaggagagataaagagggcgagatattcggggagaattagagattattaaagatatatagagagaggtaaagagagaatgagagatagagatggatagaagtgatagataaaatttgaaagggaaagaggttaaagatagaagtggagaattgagaagggagatagagatagagggatatttagagatagatttagaagaaggtttaggtagattggattatattttgggtatgtggtgtttatgtaggtaggatgggaggatgtggattgatgtagtttgtggttttgtttttagtttttagtaggggataattagaatgtggttaggttttcgtattttagtttttatatttttgttttgttttattttttttaaatattaatgataataattatagtgttttatagattttatatagatttgtatttaatttgagtattttttttatatgaaagtatttgatatatatgtatacgtgggataaggagttgttttgtttatttagtttatagatggggagattgagatttataaagggtagaggttaagggtggagttttaggttagtggggttagtttgtttattggtttattttggagggattttattatttttattttatttttttgagttttagtgtttttatatgtaatgggagatttgaggaggaaagagagtaagtttatgaatttttatttattgagtttttgttggtgtgttacgttttatgttgaatttttattagtaataaggagaacgaatataaagatatttttgatttaagtggtagtggttttaggagatggtttttagagttagtttattttcgtttatagattgttttaattattaatggattaggtgattttgggagagttattattttttttggaatttagttttttatttgtaaaaatggggtaataatatattttaataagttattttatgtagtgattggggagattaaatgagttttaatttatgttatatgattttaatttatttgaatttgaaattttaataaatattaagtatttttatttatttattgagtatttattgtatataagggagagtatatagttttttttaattttattattatttatagtattaatgttaataatatgttgatattaagagtaatattaatattgtaatattgatattgatattaaaattaattttatttttttaaatttatgattgatatataatagttgtatatatatatggggtaaaatatgatgttttgttatatgtatatattgtgtagtgattaaattaaggtaattagtatatttattattttaaatatttattttttttttgtgatgagaatattcgagaacgttttttttagttattttgaaatatatatttattgttgattttagttattgtattatgtattagaatattagaatttatgttttttatttaattgtagttttgtatttattgatagtttttttttatttttttttgttttttatttttttatttgttggtaattattattttattttttatttttatgaggatatattaatttttatagtaatatttatttaatgttaatattaattttaatttaatattaatattattattaatattaatattaattttaaaattattttaattttaataataatagtgataatgatacgtattaaatattttttggggatagtgttttattatgttatttaggttggagtgtagtgataattttggtttattgtagtttttattttttgggtttaagtgatttttttattttaattttttgaggagttgggattttaggtgtatgttattatatttagtaaaaaatttttttttaatagagatgaagtttcgttatgttgtcgaggtttgtttaattttgatattaataatagtattaatagattaataataatagtagcggtattatttgttgagtgattttaggtattgtgttaagcgttttttatttataattttatcgtatttttattagttttttgtggtgtaagtgtgtataattgtttttatttttagattggttttatataggtgtgtggaaatgaagatgtttttttagggttttgggtttttgttttaattttgatttgttgtgtgatttgttgtgtgatttttgggttagacgttttttgagttttagtttttttatttggaaaacgggtaaagttttagttttttacgtgggtaggaattatttagtatagggtttgttggtatattataaatggtgtgttttgtaaatgggaattattattattattattattattagaagtagcggtcgtaatatagggaaatttgtttttatagggaatggtaggttcgaggtatgtttaagagttaagataagggtttggtcgttggatttattttatttttttatttttggagagtatagagcgtttaggaagagaagttaagggtgaggagtagggcgttttagagttttgtttttagtaagagttggaaatttcgaggttgtgaggttaggttttattttatttttttttttattttcgtggagggggcgtaggtttagaagtttgcggcgatagtttagttagtaaggaggtagttgggagtgggtagataagggaattagtggggttagattaggttttgggggagacgagggcgggggtggggtgttttggtcgcgcgtttttttcgttaggtttaagtttgagatttttttttaatgtttttttttttcggaagttttttttgattggtttatttttttttggtattttttggggttttagagtttttgtttggtttaggttttatggtatttgtattgtttgtgttttttttgtattgtggagtttattagggtggggatagagtttgatagattgtggtgttaaaagtattaaggtaaatgttaattaaagtttggttaaggagttaagcgtttgtttttagaaataaattgttggttgattgttttaaaaaatggaaagtataaagggtgttgtaataagtatttatttttgttaaatattaatattttgttttattgattttagattgtttttaaaggatatgcgatattatagatgtttttgtattgattttatttttttttttttttttattgttttgagtttggtgtttattttttttatgagtatttttattttattattttatatgttggtatttataaatattatatgatatttggggtttttttggtttgtttttgtattttatggaaatggaagtatattatatagtatgtgttgtttttgtttagtataatgtttgtgatatttttttatattgtcgtgtgtattaatagtttatttttttttttttttttttgtttattgagatataatttatatattataaaatttgtttttaattataaaatttatttttaaaatgtatagtaaagcgattagtatattacgaggttgtgtaattatttattatttaattttagaatatttttattatttttaaaaggaattttatatttattaatatatatttttttattttatttttttttttttttattttcgggttattataaatttttttgtttttatgaatttgtttgttttggatattttatataaatgtagttatataatatgtggttttttgtaattgtttttttttattttatataagttttttaaggtttatttatattgtagtatgtattagtattttatttatttttatgattgaataatatttttttgtatgaaaatatttattatattatagttaggatgcggtggtttatatttgtaattttagtattttgggaggttgaggtgggtggattgtttgagtttaggagttcgagattagtttgggtagcgtagtaagaatacgtgtttataaaaaagaaaaattagtcgggtgtggtggtgtatgtttgtggttttagttatttggggggtttaggtgggaggattagtaagttgaggttgtagtgagttatgattgtattattgtattttagtttgggtaatagagtgagattttgttttaaaagataaaaggaaaaagaaatgttatat

SEQ ID NO: 53 - DNA, 17421 bp, Artificial Sequence
  chemically treated genomic DNA (Homo sapiens)
  unsure (515, 1325, 1345, 3705, 3707, 5320, 5410, 5417, 5420, 5426)
  unsure (7028, 7082, 7179, 8249, 8252, 8254, 8269, 8275, 8278..8279)
  unsure (9222, 9233, 9261, 12655, 12689, 12792, 13398, 14469, 15562..15563)
  unsure (15565, 15570, 15574, 15580, 15585..15586, 15589..15590, 17255)
ttatttagagaaaatgaaaatttaatttatgttaagatatttggggtgaagggaagtgttataaaattcgattggggggatggttataattttataaatttattaaaatttattgaagtgtatttttaaaataaatgaattttatagtatgttagttatattataataaggttattttaaaaataaaaatattttgagatattattttatatttgttggtattagtaaatgttaaaatattggataatgtattatgtttttaaaggtatgggggagacggtttggggtaagcgtttattgatgtatttttgggttggggtgggtaataggacgttgttaaatatataaatatatttacgttttgagttgggaattttatttataggattttatttgatatatatgttttatatttgaaaaatgtataaggaaatttattatagttttatagattatggtaaaagtttggaaataaaagatgtttgtttataggtgaaaggttatgttattgttanaaaaaaaaaaaaaaaaaaaattagagagagagagaaagaagggatgtattaaaggaaagagtagttttttgtatattgatacggtattattttaaaataaaatttgggtaaaaataaaggtgtagtatagggatgatagtgatgtgttattatttgattaaaaattggggtaaggaaaaaaaatatatatatttgtttatatattaatagaatttttttggatggaaaataaaaaaagttgtaaataatggttgatattttatttgggtttggaatttggttttgggtggttgggaatagggatggaaaaaagatttttatggtgtattttttgatttttgttgaaattatatagatagatagatgatagatagatagatagatagatagatagatagatagatagatagatggaaaaatatatatatagttatatatatatatatatatatatatattttgtataggaaaacgagattaaaatgtataatgaaaattttttgattataaagtaaagatggaaaaaagtttgttaggaagaaaagttgggggaaaattttagtcgttggttaaaatataaagaaataagaatttttttgttttattattaggaatgtaaaaaaaaaaattattttgtagagtaatttgtttgtttttggtaaatttgaagattggaatgttatacggtttagttattttttttttaggtatatgagaagtttttatatatgagtaagaaagagatgtggttaaagatatttatggagtttgttaaaaaaataagaaaaagaaattaagggtttttttagntttttcgtaatagtgcggtnttttttttttttatttttattttttttatttttttgacggttattaggtattaaatcgtcgcggagcgcgaggggggaagtatcgtagaggagttgttatgtattaaatttataagaatttttataagttaagaggtgggatagatttgaggtaaacgcgaaaagggaaggtttaaaaggagattttttagtatgtttgtgttttgggtttgaaagtgttttttattttattaggttgtttagtagagtgaggagaggaattttgagtttaagtagggaattcggtgaggaggaggtttttttttttttttattgagtttttttagtttttttgagtttttacgttatttgttttagggagaagtgggttgagtacgggttttgaagttaaatttatttggagttgattttagttcggttatttattttttgtgtggttcggtataagtttttttttttttttgagtttttgaggattatatgttataacggataggaagtttatgtttaggagaaggaaagtttatgttattttaagtttatatttggttgtttttagtttttaggttgaaattttgtatattagatttattattttttgggttgataaaatggatattaggttggaatgtatttttttagatgtttttatatgttttatgtatatatgtatgtatagttagaggagggttatgatgttttgtatagtattcggtattttgttttttgtatttaaagatttgttttagagatttatttatgttaataaatagagttatttattttttttaattattatattatttagtgaatggttatattatggtttatttagttttttttttatgattggatattgacgttatttttattgtttcgtttttataaataatggttatttttattgatgttttttggtgtgtatatataaaggttattttgagaatatttaaagaaggggaatttttatgttagataggatgtatatttgttagtttaatagatataggttagtgaaaatttattagtaaataaatataatttttaatttagtcgcgttaatattaaaggtaagttttaggtgttgtgggttttttttttaattgttaagttgtttttaaaattttataatgaatgtatgttttttgtaaaaaatagatgtttatattttttaagcgtaatttttattttttttagtttattttttttttttagttgtgaatagtggatatatatttgttatgtatttgtaaatatataaattaatacgaatttttttatataaatgagatatagatagatagatataaaatttgattttttattttattgatatattttggatatttttttatgttagtagatttatatttggatttttatttttaatggttatatagaattttattataagaaggattataataaatttatttagttttttattgatagatatttttatttttttttattttttgttattataaacgaaattgtagtgaacgtttttgtatatgtatttttgtaagttttgaaaatatattgaattaaagtaaataaaattaattttggaaacgttgatagataggtgttagaagatagaaatttattatattttggggaaaggttggtgattaggaagggattttagagggtttttgggattttaggatggtttaattttggttataagggtgtgttttgtttttgaaatttattagttgtgaattgtgcgtttttttatatgtattttatttttttgtttgtatgttatatgtaaaattttattttaatatggtaagtgaaaaatatatatatataagttttttagaggaaatgtgagagatgattgaaattttataataagttaaatttttttttattttaattttagttttagggggtatatgtgtaggtttgtttttaggtatattttagtcgggtgtaatggtttaaatttgtaattttggtattttgggagattaaggtaggaagattttttgaggttaggagtttaagattagtttgggtaatatggtaaaattttatgtttattaaaaaaaatttttaaaaatagttaggtatggtggtgtgtatttggaggttgaggtgggaggattgtatgagtttaggaggttaaaataatagggagttatgattgtgttattgtattttagtttgggtaatagagtaagattttgttttaaaaaaaaaaaaaaaaaagaggggagggtatattttatgatgttggagttagggtttttgttgattttgttatttagagagtgaatatagtatttaatagggagatttttagtttttgtttttttttttttttttttttttttggagtttttagngnttgtttttatttttatgtttatgtgtatttaagatttagtttttattttgtagtgagaatatgaggtatttggttttttatttttgtattaattatttatgataatagtttttagttgtagttatgttgttgtaaaggatatgatatttttcgggttagaagtgagtggggagtatttttaggtgatttagaagacggagattttagattatcgttttttttttattagaggttatttcggggatttttttcggaggaaaaaaaatgttattttttgttcgggggcgtttttttttagttggcgtcggcgttagttcgggtttttacggtttcgttttaggtaattgggttcgttggtttgcgaaggttacgtcggggaggggtgttttttttttttttttggagttatcggtcgggttatttttattgggttaagtatagttttgagcggtcgcgtgttcgaggtttaggtgttttttagagttttgtagtttttgtttttttttgtttttttcggtttttgttgtttcgtcgttgtcgttcgatttattttaatttttagtttatttagatagcgttcgagttaggggagggaacggtttgggtaggtaattgcgttcggattgattacgtttagcggtgaaggagcgtggcggggttagggtttcggggagaggttatttagagggtgtgcggttcgggtttttggggagggggtagttggtggttagttattgttagggaggtttagagtatcgagggatttcggagtgttcgtaagaggggttgtaggggtcgggttttggggtgagggttttttagtggtggggcgcgttggtagtaggggtcgttaggagcgcgtagggagggggttcgtcggttgaggggggtcggttcgcgggttagtttcggagtttagcggttcgggaattgcggacgtagttaatgggaggcggaggttgggaggcgcgcggcgttgattggttggtttgggttttttaggcgtgcgcggttttcgttttatgtttgtgtaggagtcggtagttggcgttagggcggtcggaggatgtcgaggggtcggagtcgggagggttcgaggtcgaggcgtattttatttttagtttttattttgtaagtttcgttagttttcggacgtgttgtttttgggttcgtcgttttcggggttttcgtcggaatttttttatttttagaggtcgagttttttttttttttacggttgcgtgtgtaagtttggggtttgagagtcggttgggggtttggggcgtttttagttttgaggggattttggggggatttagggcggggggttaggttgcgggcgattgttttggtgtgttttgttgagaggttttgattgtgtcgtttagtattgcgtttagggggttgcgtgtgtatgttttcggggttgagattagtatgtgtatttggcgttaagtgtgggtgtgtgcgtgtcgttgggattaagtgttatattgggtgttcgggcgtttgtttttaatttttgagtttgtgtttatgtgtttgtttatcgggcgggggggtttagtgtgagtgtttgattgaagtgttgttttgtgcgtttgttggggttnttggtgtcgggattcgtgtttttgtcgtgattttagtgttcgaaagatgttttggagtcgcgggtcggttttcgagtggttttttagggnggtttanttntttatntatgggcgtttttaaataaaaaaattcgtttttgttttatattttgaagatttagtttttttttttttgggtgattatagttagggatgggataataagagttaagggtaaattagttcggggttggtattggtgattttatttgttttgttattttttgtatttggagttttaaaggtatagtttggtatacggtaggattttaataaatagtggatgaatagattggggtttttaatttattttagtatttatagaagttgtttagagtttataaaataatttttgtatttgtgagggtttttaggtgttaggtttataaagggaggtatgttatggtcgtggtattttgtttggttaggattcgagaggagttttttaattggaggatttagtttaagttgttttattttttgtttagtggagtttggttttttttttagtttttattaatatttagaattttttatgatgagtttttattttattagggtagagagtgggtatgtttttattagggagagaaaggatagagatagatagataggaagagagaaatagttatgtagttagggttggggttttgtttgttattgttttttatgtattttaattgtggtaaaatttgtgtaaagtatatggatgttattaattattggtaaaggaataggaagtatatttttgtggttcggtaaatgcgtggggatggttttatttatattttgtaggaagaaattaaattaattgataggtttaaatgtgagtggataggtggggtagtaggagttttgtacgttattggtgggagtgttttttggaaagtgtattttgtaagagaatttggtaatattaataaggacgtgtgtataggtgagtttagtagttttttgtataggtaaaattttagtagtatttattgatataaatataattatagtaataacgtttgggagttatttaggtttatttataggagaaaggataaatgaattatgttatgtttatataatggaatattcgatagtaatgaagacgaataatagtgttacgtattaacgtagatgtattttttaataatattgtgagagaaaaaggtaagttattaaataatacgtatgtatgaggttatttaaatagtttttttggattttatttttggggatgttaaggatttattagagtttttaagttatgtttatatgttatttttttgattaaagggatatgattaataaatgtaatgtggggtttttttttggattttagagtaggatagaaatagttataaaggatatttttgggataattgacgtttagatatggattgtggggttcgattatagtattatattaatgtaaattgttttagttttgataagtatatgtgtttatgtaagagaatgtttttgtttttagggaataaatattgaaatatataatagtagagaggtattatgtttttattatatttttagatggtttaggagaaatatgcgtgtgttttcgtatatattaatatagagagaatggtatagttagggggttaagttgtaagtaattgggtgaatttaggtaaagggtatatgggaaatgttattatanttaaaagttatgattatgggggagaaaatttagtttttttataaaatagttttntagtttttttttttagtataatttgtttttatacgtggggtattcggtatttatgttttggtttttgtttttttgggttttagttttatttagtatnttatatttaaaggttatgtttttatagatgtgtatttttaagattaaatatatatttgaggtatttatgtgattatatatatttatggaaaaagaaaatttttgggtttataaaattgaacgttttagggtggattgttttaggtggttttaatcggggtgttgataatatttagacgagtacgtaggtttttttttttgttacggcggtgttattttttaacggattttgtcgtcgtggttgtaagatggtggtagtagttttaatttttgtatttttttgtggttaagtttagtgggaagaatgtgaggtttttttttagaagtttttgtagatttttattagttttagttgggttatgtgtttgttatttttgatttggtttttggggttaggaaggtattatggttagattggttaggtttgagttttaagttttaagtttaatttttttataaagtatagttggttggggtagagcggtgtttttagtggaaaattaagatgtagttttagaaggatggaaatggatgttgggtggcgaaacggtagaaatttatttcggtttacgtttttgtttgtttaaaatttatgtatatgtttttttttatgttttttttgggggaggtgtgttaggtagtatagatgtatgtatagttttttatagatgttatttttatttttggaaattgttaatgtttatgaatttgttattttacgtagtaaaagagattttgtagatgtaattaaggttgttcgttagttgattttaaaatagggagagtgttttggattatttatatgggtttagtgggttatataagtttttaaaagtagagaattttttatggttggtggtagaggagaaaggatattggaaagagatagtatgggggaaagggagatttaaagtttgggaaggaaggatggaaagcgcgattgttgttttgaaaataaaggaagttttaggttacgtagtaaagaaatggagattttaggtttgtaagtataagcgattgaattttatttataattttaatgagtattttcgggaaagaagttagtttatnaantngggggaagttacgantagttncgnnnaagaggttattgaaagttatagttgttttatatggtttttaacgtttgttattgtgtagtttttttaattttagttattttttgtgagtatatagtgtttttaatttgtagttttttaaagataagtgatgttgagtattttgttatgtttttattgggtatttatatatttttttttatgaagtggttgtttaaattatttgtttattaaagaaaaaattagatagtatgttttattattgaattgtaggagatttgtttttagaaaaattaaattttggatataagtttttattagatatttattttttttaagtattttttttaagtttgaggtttgatttgagttttaatattaagaaattagaaaaagagaataaaataagttgaaaaaagaagtaaaatgaatagaaatttatgaaatagataatagagaaattatagataaaattagtgaatttaaaatttggtttttttaaatgaataataaaattgataagtttataatttgattgtttaagaaaaaagatataaattattaatattaagaatgaaagaagagatattattagagattttataggtatttaaaggattataagaaaatgtgaataaatttgtgttaataaatttggttatttagataaaatggataattgttttgaaagatatgaattgttaaaattggtttagaagaaatagaatttttgaatagttttttattaattaaagaaattgattttgttatttaaaatttttttataagaaaatattaaggaaaaaataatataaattttggttaggtgcggtggtttaggtttataattttagtattttgggaggttgaggtgggtggattatttgaggttagaagttcgagattagtttggttaatatggtgaaattttatttatattaaaaatataaaaaaaaaaaaaaatnttaggtgggtncggtagtgggcgtttgtaattttagttnttagggagggtgaggtaggagaattattttgaggtagaggttgtagtgagtcgagatcgcgttattgtattttagtttgggtaacgagagtaaaattttatttaaataaataaataaataaataaatgtttttttaaaatttttaggttatttgtggtttcgttaggtgaagttggtggttaatagtaaagataggttttatgagatttgtttttatttttgtagttttttgttagtgtttgtggtaaggttttaatttttttttggtttagttttttttttttttttttttgagatagagttttattttattatttaggttggagtgtagtggtgtaattttagtttattgtaatttttgttatttgggttttagcgattcgtttgttttagttttttcgagtagttgggattataggagtgtgttattacgtttggttaatttttgtagtattagtagagatggggttttattatgttgtttaggttggttttgaatttttgattttatgatttatttgtttcggttttttaaagtgttgggattataggtatgagttattgtgttcggttaagttatgaaatgtttaagtgaaggttttttttggaacgtgatttttttacgttgggttttaggaatggtttaaagttggattgtagatttaaaaggttttgattttttaggatgtgtggtataggtgagtataatgaaatttgatatttttatttgatcgttggtttttttaggatttgattgttttaagtgttaggaatagtagtatgttttatttggtgtttttttgagggttgggttgtaggagtagtttaagagggatttttagtgattgtatggagcggtgtcgtttgcgtattttaggttaggttggttttagtatttgtttgttttgttaaaggatggtttttgcggtttgggtttatagggatttgttagtaatgttagttttgttttcggaataacgtgatttagggggttttttttttttaacggggttttttttatcgaggtaagtttatcgtcgataggttttaagtttgttagcgtcggtaggtttttttttttttataattagttttttttttaggggggtttaatttttttttttttgattttttttattaggggaaagaattttttatgtttggttttggtttatatttattttttgttaaagagatttatttttttttttttcgaggttttaataattatttttgtgggatcgggttagttttgaaattgtggtatttttttatttttaacgtttgtggggggatgttttggttcgagatttgtttttttttttttgaacggaaggggagtttaaacgaaagtatgttcgcggtcgttaaatcgagggagtgtttttttacggagagggttttcgcggggatattttatattcgacgtatttttaatttttttataattttcgtttatgaaaaagcggtattgtgcgtttgtgatcgtattttttatttattttagcgttatggttaaatgttgcgggacgttgaaaattaatgaaaagataagtcgcggaatgggagaaaatatttgtaagttatatttttgatgaaggtttagtgtttagaatatataaagaattttttaaatttaataataaaaagataaataatttaattttttaaatggataaaagatttgaatgggtatttttttaaagaagatagataagtggtaataaatatatgaaataatgtttagtattagtaaaatgatgtgtattagaaaatgtatattaaagttatagtgagatattattttatattcgttagggtggttgtaataaagatggacgatagtaatggtgaggatgttgaagtattggaatttttttgcgttgtttttggggaatgtaagatggtgtagttattttggaaataagtaggtagttttttgaaaagttaaatatgaagttattatatgatttattttttgtttttaggtatatatttaagagaattgaaaataaatgtttaaataaaaatttatattatgtttaaagtagtattatttttaatagttaaaggatataaataatttaaatgtttattaattgatgaatggatgggtaaagtatggaatgttgatgttatgtaattttatttagttataaaaatagtgaaaaagtgatatgtaaattatatttttttggagtataaatattttaattgtttaaaatgatattttttttaagagttatttttagtttaaagtttattttttgaagtgttatattcgttaattttttaagagatataaaattatgagaagatattattagaagttatgtaaatattttagttaaaggtaaaaggaaagttaagggtgtttttataaggaaatttaaagaagataattagaaggaaataagtttaatatggttatattaatttgggtaaaagaattagagtggaaatttaagttgtcgagaaagcgggagaaggaaagaaaatttggtttaaatagatcgtataaggaaattttatataaattttggttttggtattatttggtaatttttatttttggttataggtgattttaatattggttttattgttgtaaaataagtttaaatattattagttaaaaagaaattttttattgatttgttgggtaggtggtatttatgtttttttttattaagagattagttttggtaagagggttttagtgtattttgatggtgtttttggtaggatgtttagtgatgttttgttgtttgagatataaggtgggaggagagtgtatttcgtttattatttaatcgatattttggttttgaagaagtaatataggtagaaaatttgttaggtggttagtttaatgaagtagaatattaaagagatattgaagtatagggtttaagtgtttgttgatttattagtattatatattttttttttttttacgtagtaaaattattaataatagattttgataggttttttaggtattgtagttttatttataacggtttaagttttttcgtttttgtaaattttttgtaattttttttttgtttttattttatgttttatgtttaggattacgaattgattaggtatttattttgtttttttgtttttaaattatattttatatatgttataattttttaggataaaggtaaattattttttggtgtattttttttggagtagagaatgtggttagtagaatttgtgattttgaggtggttgtgtaggttgttagtatttttagatttgttggagatttcgtacgtatttattattagtaggtttttgtggatttttttatggaggaatttttaggagttaatgggtaggtggaaggagatggtgaggattaggttggggttgagtntaaataaaaatagttatgttaatattgtttttgnaaaaaaaaacggagttaagagtgaagtattgatgtatgttatgttttagataaatattaaattatgttacgtgaaagaagttcgatttagaaggttgtttgtntttttgtttttatatgaggtgttttgttaaggtttttttatagagatagaatgtagatgagagttttttagaggttgggggatagggtgagtgaggagtgattgttaaggagtatagagattttttatggggtgataaaaatattttgaaattagaatagtggtattagataggagtgatggttgtaaaatttggatatatttaagatgattgaattatagaagtttttaaggtgaatttatggtaagtgaattatattttaataaaaaatattaataagtaataagatattttaaattttagttatgtatatggttatttagttagtgattacgttttttagtttttttgtaattagcgtggttatgtgattaagtttgggttaataagattttaggagaagtgatgagttttaataagttgttttttttggagtttttatttttttttttttgggttggagggtaaatatggaggtgattattgcgttattaggggttagatagatatttttgtggagaagagttgttttgttagttttgggttgttttttagtagattgttttttgaggagggaataagttaaagttatgaagagatttattntttttttttgttttttgttttgacgtgtttttttttgaggtaatgagtatagaaatgatttgatgatttgaataggggaggaggtaaaagagggtttgaaggaagtttttggttataaattgataatttaaaatattttttttagagtatttttatggtttttagatgagtttagatattaatggtttttttaagggttggatttgttagatttggataggttaggagggattttaaagtatttttttatagtgattttgtttaatttaatattttattttttgtgttatttgttgatttgtttttattgattaatttttttttttatatttttttgtttttttgtatgtttgatgatttttgattgaatagtagatttataagtgttttgattttgggtgttggatttttgtttgtttgtgttttgttttgggatagagtttgatttttttgtgatttgtttttaagtattgatttagaatagtttttaatttaggattaatttggttttattgttgagttttattttggttagtgggaatatgaatattttttggttttgtgttaattttagggattgttttgtttgttattttttcgtggttttttatttagttttataagtttttttatatatatgtaatgattagtattttattgattaattaaggagagttttgtgtagaattttagtattatttattttttttttttagttttttttttggtattttgttttgttaattttgtttattttgttttttgaatattgtttttgtaaattagggagattataagaatttgtttaagttttttttttagtattggagtttgaaattttttttagagatgagatagtatagcgatggggtttattttatttgtttttatttttttagagattattattttgtattgttggtaaaatttgaaaattattgttttgtatattttgttttgtttagttgtttaagatgggagggtaagtttattttttgttatattattatgattagaagtagaagttatataatttgatttgtttaaatattaataaaaaaggttttttangttaggtgattagagttttgaattgaattgttataatagggagttatagttttttatttagtttttagattaaagttagtttatagattaggtattttttgaataaagaggaggttggaatttttgaggaattattttgtgatattgtttttaagttaggtttaagagatttaggtatggtattttttttagaagtgttgagaaaagttattttttttttgttgggattgtttagttaggaagaggtttggatggagatgttgtggttattgtggggtgggttaagatatatggaggaaataagaataaagaaatggatatagtttggtttttgaagttattttttgagtttttatattagttttgtgggttatggttgtttagttttatgagttaatgtattatttgttttgtttaagtcgttttgaggtgggtttttgtgttgggttgagatttgaggaatttgtgttagggtatgaaaggagttttttgagagaggaagtatttttagggtttggattatatgaaatagtttaggaaaaatttaggtaatgtgagtttgtagattttaattgggaatgttaattagggatattaaggagtttatttagttttaagaagatgaggggggtaaattagatattttaattttagagtttaatttttgttaggatattatttgtagtttttttgggatttttatgtttttttttttgtttttataagtatatgtgatatttgatttgtgataggtttggggttagtgttttagtggggaggtatatttagttttttttgtattgttataaagaaatatttgagattgggtaatttataaagaaaagaggtttaattggtttatggttttgtaggttgtataagtatggtgttggtatttgtttggtttttggggaggttttaagaagtttatagttatggtggacggtgaagtaggattaggtattttatatagtaaaagtaggagtaaaagagagagagagtgggagggggtaggtggtatatacgataaataattagattttaaagaatttattatagtgaggatagtattaagtttgtgggtttattattnngnggganattnatcgantagtnnttnntaatatgttatatttttgtttttttatttttattttattttttttttttgtattaaatattttttaatttagtttttaaatttatgtaatgttatttttaatatatttttttgaggtatttttttagtggttgatttagggtttattattaattttagatttttattaatttaattttaatgagatgttatttttaatagttttatttattttttttttttttttatagtattattgttatttttatatattatatttatgaatgttataaatttaatattatagtgttataattattattttatataattttaggttttaaagaagttgtgaggagaaaagagagtaattatgtatttatagtttttattatattagttatgttatttattattttttgtttttttaaaaaaataattgaagttttgttttggtattttttttggattatgttttttttattttttttttagattaattttaatttgtattttttttttgtgataaattgtaattgtgaatttaatagtttttagtgagttttgtgagtttttttagtgaattgttaaaatttggggattttttaaatttgtaattaatattaaaagtaagggtagttttatgtggattgtgttttttttgatttcgtatttggtttaaattgtataaataatttttaaggttagtgtttgaaatttgttttaatttttaagacggttttttttagttgttttttttttatttttatttagtaaagtagttagtttgtagtttagtttgtttttttattgaatttagtaatattttttttatggttttttattataatttttattgatttttagagcgtttttaggtttgaatttttttaaattttgttgtatataaagttagtttttttggggagagatttggagttttttattttatggtttgtttttttttttgggtaaaatttttgagtttcggttttggtaatttggggtaggaattaatggtatgttttttttttaggggtattttagttttaggagttgagtattagtggaaagggggaggaattatttttaggttttttaagtttatttttttagggggattttttttttataggacggggttaaatcgtcggggttttagatttcggggggtttttgtttttgtttagtttttgtgttaaaatgggggggattcgattaaaagaaatttttttttttaaaagtttttgttcggaatttaatttcgataaaaaaaattcgtgggttaaaaaaaaaaaaattcgaatttttttttttttcgaggaaattttttttaaaaaacgtttcgtacggaagtgaaaaataattttttattttataattttttttacgacgttggtggggggggggtttttttggggattttaaagggttttttttttggggtgttcgggggcgttttttttttttattttttttgagttcggggttttatggggtttggtttattcgggtcggggggggttttaagtttgagtggtttgatttaaagttttggttttggtgcgtttggttggggtttattggtgtcgggaattcgtttttcgggcgtgatttttatgtgtacgggtgtgtgattttggagtcgcgggttattacgtgagtgtgcgtggttgaattttttttntcgtttttttttcgttttgagttttgggttttttttttattcgggattggtgttttttttcgtcggatttgggttggggtttcgtggcgtgcgggatatttcgtggtgggattttggggggtgttaggcgttggcggtacgttttattttttttttttcgcgtagg

SEQ ID NO: 54 - DNA, 17421 bp, Artificial Sequence
  chemically treated genomic DNA (Homo sapiens)
  unsure (167, 1832..1833, 1836..1837, 1842, 1848, 1852, 1857, 1859..1860)
  unsure (2953, 4024, 4630, 4733, 4767, 8161, 8189, 8200, 9142..9143)
  unsure (9147, 9153, 9168, 9170, 9173, 10243, 10340, 10394, 11996)
  unsure (12002, 12005, 12012, 12102, 13715, 13717, 16077, 16097, 16907)
tttgcgcgaggaagggggagtgaggcgtgtcgttagcgtttgatattttttaaagttttattacgaggtgtttcgtacgttacggagttttagtttagattcggcgagaaagagtattagtttcgggtgggaggaaagtttaaggtttaaaacgaaaggaaggcggnggagggggtttagttacgtatatttacgtggtgattcgcggttttagaattatatattcgtgtatatgggggttacgttcggggaacgggttttcgatattagtggattttaattaaacgtattagagttagaattttaagttagattatttaaatttgaggtttttttcggttcgggtagattaaattttatggaatttcggatttaaaaaaggtgggaagaaagggcgttttcgggtattttaaggggggggttttttgggatttttagggggattttttttttattagcgtcgtggggaaaattatagggtgggaggttgttttttattttcgtacgggacgttttttgaggggggttttttcgggggggggggagattcgaatttttttttttttggtttacgaattttttttgtcggagttaaatttcggataagggtttttaggagggggggttttttttggtcgagttttttttattttggtatagaggttaggtaggggtaaaaatttttcgaaatttggggtttcgacggtttaatttcgttttgtggaaaaaggatttttttgggaaggtaaatttaggggatttgggggtggtttttttttttttttattggtgtttagtttttaaaattggggtgtttttgaaaggagagtatgttattggtttttgttttaaattattagaatcggggtttaaagattttgtttagagagagaagtaagttataaaatagaaaattttaaatttttttttaaaggaattgattttatatgtaatagagtttggagaaatttaagtttaagagcgttttgaaaattagtggaggttgtggtgaaaggttatgagggggatgttgttagatttagtggagaaataggttaaattgtaagttggttattttgttgaatagaaatggggaagagatagttgggaggggtcgttttgggagttagaataagttttaaatattaattttgggaattatttgtgtagtttaggttaagtgcgaagttagaggggatatagtttatatgagattgtttttatttttaatattaattgtaagtttggggggtttttaagttttgatagtttattggaaagatttatagaatttattaaaagttgttaaatttatagttatagtttattatagggaaaggatatagattgagattagtttgagaaagaggtaaagagggtatagtttaggaaaagtattaaagtagaattttaattgtttttttaagagaataaggaatgataaataatatggttaatataataaaaattataaatatatagttgtttttttttttttttatagtttttttgagatttgaagttatgtaaagtaataattataatattgtaatgttgggtttatagtatttataaatgtaatatataaaaataataataatattgtaaaaaagggggaaaagtgaatagagttattaggagtaatattttattggagttaagttagtaaaaatttgaagttgatggtaagttttagattaattattaaggaaatattttaaaagaatatattgaaaataatattatataaatttaaaggttaaattagaaaatatttaatgtaaagggaaggagtaaagtaggaatagaaaaataaggatataatatattgnnggnngttgntcggtnaatnttttntnnggtggtgggtttataggtttggtgttgtttttattgtagtaagttttttaagatttaattgtttatcgtgtgtgttatttatttttttttatttttttttttttttgtttttgtttttgttatatgaggtatttgattttgttttatcgtttattatgattgtaagttttttgaggtttttttagaagttaagtagatgttagtattatgtttgtatagtttgtagaattatgaattaattaaattttttttttttataaattatttagttttaggtatttttttataataatgtaagaaaagttgaatatatttttttattggagtattagttttagatttgttataagttagatgttatatatgtttatagagataagaaagaggatatggaagttttagaggggttgtaggtagtattttggtaagggttgagttttggaattgggatgtttggtttgttttttttatttttttggggttaggtgagttttttggtatttttagttggtatttttaattggaatttgtagatttatattgtttggattttttttgggttattttatgtgatttagattttgggagtgtttttttttttaagaagttttttttatgttttgatataaattttttaggttttaatttaatatagaaatttattttaaagcgatttaagtaaaataggtaatatattggtttatgagattgaataattatgatttataaggttggtgtgggggtttaaaaggtggttttaggaattaggttgtgtttatttttttgtttttgttttttttatatgttttgatttattttataatggttatagtatttttatttaaatttttttttagttgagtaattttagtagagaaagagtaattttttttagtatttttaaaaggaatattatgtttgagttttttgggtttggtttgggggtaatgttataaggtaattttttagggattttagttttttttttatttaagggatatttggtttgtgaattggttttggtttgggaattggataagggattgtgattttttattatggtaatttaatttagggttttagttatttgatntaaagaattttttttgttggtgtttaggtagattaaattatatgatttttgtttttggttatgatggtataatagggagtagatttatttttttattttaaataattaaataaaataaaatatgtaaaataatggtttttagattttattaatagtgtaggatgatgatttttgagggaatgaaaataaatgaggtgagttttatcgttgtgttgttttatttttgaagggagttttaggttttagtgttgggagggaggtttaaatagatttttgtggtttttttgatttatagagatagtgtttagaagataaggtagatagaattaataaggtagagtattagaaagagagttgaagagagggggtaggtggtattgaaattttgtatagggttttttttggttagttagtggaatattgattattgtatgtatgtgaagaaatttgtgaggttaggtaaagaattacggaaaagtagtagatagaataatttttagggttgatatagggttaggaagtgtttatgtttttattggttagaatggaatttaataatggggttaaattagttttagattaaaggttattttgggttaatgtttaaaagtaagttataaaagaattaaattttattttagaataaagtataaatagataaaaatttagtatttaggattaaaatatttataaatttgttatttaattaaaaattattagatatgtaaagaaataggaaaatataaggagaaaaattaattaatagaaatagattaataaatgatataaaaaatagaatattagattaggtagaattattataaaaaaatgttttgaagttttttttggtttatttagatttgatagatttagtttttggaggggttattagtatttgagtttatttaagagttatgaaagtattttgaggaagatgttttaaattattaatttgtgattaaagattttttttaagtttttttttatttttttttttatttaggttattaggttatttttgtatttattgttttagggagggatacgttaaagtaggaagtagagggaaanaatgagtttttttatggttttggtttattttttttttaagaagtagtttgttgaggagtagtttagggttggtagggtagtttttttttataagagtatttgtttagtttttggtggcgtaatgattatttttatgtttgttttttagtttaggggaaggagaatgaggattttagaggaaatagtttattggggtttattattttttttggaattttattagtttaagtttaattatatgattacgttgattataaagaggttgggaaacgtggttattagttgggtggttatgtatataattaaaatttggagtgttttattatttgttaatattttttgttgaggtataatttatttattataaatttattttaaaaatttttgtgatttaattattttgaatatatttagattttgtaattattatttttatttaatattattgttttaattttagaatatttttattattttataaagaatttttgtgttttttagtagttattttttatttattttattttttaatttttggaaagtttttatttatattttgtttttatgggaaggttttggtaggatattttatgtaaaggtaaaganataggtagttttttgggtcggattttttttacgtaatatgatttaatgtttatttagggtatagtatatattagtgttttatttttgatttcgtttttttttntagaaataatgttggtatggttgtttttgtttangtttagttttagtttggtttttattatttttttttatttgtttattaatttttgaaagtttttttatgaggagatttataaggatttgttagtgatgggtgcgtacgagatttttaataagtttgggggtgttggtagtttgtatagttattttaaggttatagattttgttggttatattttttattttaaagaggatgtattaaagggtaatttgtttttattttggaagattatgatatgtatgaagtgtgatttgagagtaaggaaatagggtggatatttgattaattcgtaattttagatatgaagtatggagtagaggtagaaaagaaattataaggagtttataaaagcgagaaagtttaaatcgttatagatggagttgtaatgtttagaagatttgttagaatttattgttaatgattttgttacgtgaagaagagagagatgtgtagtattaatgaattaataaatatttgagttttgtattttagtgtttttttaatgttttgttttattggattagttatttggtaggttttttatttgtgttgtttttttaaggttaagatgtcgattgagtaatgaacgaagtgtattttttttttattttgtattttaggtagtagaatattattgggtattttattaaaagtattattaaaatgtattggagtttttttgttagaattgattttttggtgggggaggatatgggtattatttatttaataagttaatgagagatttttttttagttggtagtatttggatttgttttgtaataataggattagtattagagttatttatgattaaaaataagggttattaaataatgttaaagttaggatttgtataaggtttttttgtgcgatttgtttgaattaagttttttttttttttttcgttttttcggtagtttgaatttttattttagtttttttatttagattggtatggttatgttgaatttgtttttttttggttgttttttttgggtttttttgtgaaaatatttttaattttttttttgtttttagttgaaatgtttatatagtttttggtgatatttttttataattttatgttttttaaaaggttgacggatgtgatattttaaaaagtgagttttgaattgaagataatttttaaagaaaatattattttagataattaaaatatttatgttttaaaaagatataatttatatattatttttttattgtttttatggttaaataaaattatatggtattaatattttatattttgtttatttatttattagttggtggatatttggattgtttatattttttagttattaggaataatgttgttttgaatataatgtaagtttttgtttgaatatttgtttttagtttttttggatatatatttaggagtagaagatgggttatatggtagttttatgtttaattttttaagaaattgtttgtttgtttttaaaatggttgtattattttatattttttagaagtaacgtaagagggttttaatgttttaatatttttattattgttatcgtttatttttattatagttattttagcggatgtaaagtggtgttttattgtagttttgatgtgtattttttgatgtatattattttattgatgttgagtattattttatgtgtttgttgttatttgtttattttttttggagaaatgtttatttaagttttttgtttatttaaaaaattggattatttgtttttttattgttgagtttaaggagttttttatatattttagatattagatttttattagagatatgatttgtaaatatttttttttatttcgcggtttgtttttttattgatttttaacgtttcgtaatatttaattataacgttagagtgagtgaagaatgcggttataagcgtataatatcgtttttttataagcggggattgtaaagaggttgggaatacgtcgggtataaaatattttcgcgagaatttttttcgtgggaaaatattttttcgatttgacggtcgcgggtatattttcgtttaagtttttttttcgtttagggaggagaggataggtttcgagttagaatatttttttatagacgttgggggtgaaggggtattatagttttaaggttaattcggttttatagaaataattgttggggtttcgggagggaaaaaagtaggtttttttaataaaaggtagatgtgggttaaaattagatatgggagatttttttttttggtgaaaaaagttaaaagggaaaaggttgggtttttttgaagaaaaagttagttgtgagagagggggggtttatcggcgttagtaagtttaaggtttgtcggcgataggtttatttcggtaaaggaagtttcgttaagaagaaaagattttttgaattacgttgtttcggaagtaaggttgatattgttggtaagtttttgtgggtttaagtcgtaaggattattttttggtaggataggtagatgttagagttagtttggtttagggtgcgtaggcgatatcgttttatgtagttattaggggttttttttaagttgtttttatagtttagtttttaaaggaatattaagtgggatatgttgttgtttttggtatttaggatagttaggttttaagagggttagcggttaaatgggaatgttaggttttattatgtttatttatgttatatattttggaaaattaagattttttgaatttataatttaattttaagttatttttagggtttaacgtggggaagttacgttttagagagaatttttatttaaatattttatgatttggtcgggtatagtggtttatgtttgtaattttagtattttgggaggtcgaggtaggtggattatgaggttaggagtttaagattagtttgaataatatggtgaaattttatttttattaatattataaaaattagttaggcgtggtggtatatttttgtaattttagttattcggggaggttgaggtaggcgaatcgttagaatttaggtgatagaggttgtagtgagttgagattgtattattgtattttagtttgggtgatagagtgagattttgttttaaaaaaaaaaaaaaaggaaattgagttaaaaagaggttaggattttgttatagatattggtaggggattgtaggagtggggataggttttatgaagtttgtttttgttgttaattattagttttatttggcgggattataggtggtttggaagttttaaaggagtatttatttatttatttatttatttagatggagttttgttttcgttgtttagattggagtgtagtggcgcgatttcggtttattgtaatttttgttttaaaatgatttttttgttttattttttttagnagttgggattataggcgtttattatcgngtttatttaangtttttttttttttttgtatttttagtatagatggggttttattatgttggttaggttggtttcgaatttttgattttagatgatttatttattttagttttttaaagtgttgggattataggtttgagttatcgtatttggttaggatttatattattttttttttaatgtttttttgtggaaaggttttaaatgataaaattaatttttttaattgatagagaattatttaaaagttttattttttttggattagttttggtaatttatgttttttaaggtaattgtttattttatttaggtagttaaatttattggtataaatttgtttatatttttttataattttttaaatgtttgtaggatttttaatgatgtttttttttttatttttgatattggtaatttgtatttttttttttgagtaattaagttgtaggtttattaattttattgtttatttagaagaattagattttggatttattgattttatttatgatttttttattgtttattttatagatttttgtttattttatttttttttttaatttattttgttttttttttttgattttttaatgttggaatttagattaagttttaaatttggaaaaaatatttgaaaaaaatagatatttggtaagggtttgtatttagaatttagtttttttaaaaataaattttttatagtttaataataggatatgttatttgattttttttttagtggatagatgatttgaatagttattttataaaagaagatgtatgaatgtttagtaagaatatgataagatatttaatattatttgtttttaaggaattgtaaattaaaggtattatatatttataaaaaatggttaaagttaaaaagattgtataataataagcgttgaagattatgtggagtaattgtaatttttaataattttttnnncgnggttgntcgtaattttttttngnttngtgggttaatttttttttcggaggtgtttattagggttgtgagtagaatttagtcgtttatgtttgtaggtttggggtttttatttttttgttacgtggtttgaggttttttttgtttttaaagtagtagtcgcgttttttattttttttttttaagttttaaattttttttttttttatgttgtttttttttaatgtttttttttttttgttattagttatggaaagttttttgtttttaagggtttgtgtgatttattgagtttatgtggatgatttaagatattttttttattttaaggttaattgacgagtagttttaattatatttgtaaagttttttttgttacgtgaggtaataaatttatgggtattgatagtttttaaggatgagggtggtatttgtggggagttgtgtatatatttgtgttgtttagtatattttttttagagggagtatgggaagaagtatgtgtatggattttggataggtaagggcgtgggtcggggtgggtttttgtcgtttcgttatttagtatttatttttatttttttgaaattgtattttgattttttattgggggtatcgttttgttttagttagttgtgttttgtgaagaggttggatttggggtttggggtttaggtttggttagtttgattatggtgtttttttgattttagaggttaggttagggatgatagatatatgatttagttgaagttaatgagaatttgtagaagtttttggaagaagattttatattttttttattggatttggttataaaagggtgtaggggttggagttgttgttattattttgtagttacggcggtagagttcgttggagaatggtatcgtcgtggtagggagagaagtttgcgtgttcgtttggatgttgttagtatttcgattaaggttatttgagatagtttattttggagcgtttagttttgtgagtttaagaattttttttttttataaatatgtatagttatatgaatgttttaagtgtgtgtttagttttgagggtatatatttgtgaaaatatgatttttgggtgtggngtgttaagtgggattaagatttagagagataagagttagagtatgggtgtcgggtgttttacgtgtggggataggttgtgttggaaggagaggttgnagggttgttttatagaagaattgggtttttttttttatggttataatttttaantgtgatggtattttttatatattttttatttagatttatttaattgtttataatttggttttttggttgtattattttttttatattaatatgtacggagatatacgtatattttttttgaattatttgagagtatggtggagatatgatgtttttttattattgtatattttagtgtttgttttttaaaaataaggatatttttttatataaatatatatgtttattagagttaggataatttgtattgatatgatattatgatcgaattttataatttatatttaaacgttaattgttttaagaatgttttttatagttatttttgttttgttttaggatttagaaaaggattttatattgtatttattggttatgtttttttagttaaggaggtgatatgtgaatatggtttggaaattttagtgggtttttgatatttttaggagtgaaatttagaagagttatttgaatggttttatatatacgtgttgtttggtgatttgttttttttttttatagtattgttgggaggtatatttgcgttgatgcgtgatattgttgttcgtttttattgttgtcgagtattttattgtgtgggtatgatatggtttatttatttttttttttgtgaatggatttgggtggtttttaggcgttgttattgtggttgtgtttatattagtggatgttgttgagattttatttgtgtagggaattgttgagtttatttgtatatacgtttttgttagtgttgttaaatttttttataaagtgtattttttaaaaaatatttttattagtggcgtgtagagtttttgttgttttatttgtttatttatatttggatttgttaattaatttaatttttttttgtaggatgtggatgaagttatttttacgtatttgtcgggttataggaatatgttttttatttttttgttagtggttggtagtatttatgtattttgtataggttttgttatagttagagtgtatagagggtaatggtaagtagagttttagttttggttgtatggttgtttttttttttttgtttgtttgtttttgttttttttttttttgatgaggatatgtttattttttgttttggtgggataggagtttattatggaggattttgggtgttgatggaggttgagagagaggttaggttttattggatagggaatgaagtaatttgggttaaattttttaattgggaggtttttttcggattttggttaagtagaatgttacggttataatatgtttttttttgtgggtttagtatttaggagtttttataggtataagagttgttttgtggattttaaatagtttttataggtgttaaggtgagttgagaattttaatttatttatttattgtttattgaggttttatcgtgtgttaggttgtgtttttgaagttttagatgtagaagataataagatagatgaagttattagtgttagtttcgggttagtttgtttttagtttttgttattttatttttggttatggttatttaaagggaggggagttgagtttttaaggtgtgaggtagaggcgggtttttttatttaaaagcgtttatgnatgganaantaagttnttttggggggttattcggagatcgattcgcggttttaaaatatttttcgggtattggggttacgataagggtacgggtttcgatattagngattttaataaacgtatagagtagtattttagttagatatttatattgagttttttcgttcggtagataaatatatgaatatagatttaaaagttggagataggcgttcgggtatttagtgtggtatttgattttagcgatacgtatatatttatatttggcgttagatatatatattgattttaatttcgaaaatatgtatacgtagttttttgagcgtagtattaagcggtataattaggattttttaataaagtatattaaagtagtcgttcgtagtttggtttttcgttttaagtttttttagagtttttttaaagttaggagcgttttaggtttttagtcggtttttaaattttaaatttatatacgtagtcgtggggaggggagggattcggtttttgagagtgaaggagtttcggcgggagtttcgagggcgacgggtttagggatagtacgttcggaggttggcggggtttatagggtaggagttgggggtagagtgcgtttcggtttcgggttttttcggtttcggtttttcggtatttttcggtcgttttggcgttagttgtcgatttttgtatagatatgaagcgggggtcgcgtacgtttaagaagtttaagttagttaattaacgtcgcgcgttttttagttttcgttttttattggttgcgttcgtaattttcgaatcgttggatttcgggattgattcgcgggtcggttttttttagtcggcgggttttttttttgcgcgtttttggcggtttttgttgttaacgcgttttattattaagggatttttattttaaggttcgatttttgtagttttttttgcgaatatttcgggatttttcgatgttttgggtttttttagtagtaattaattattaattgttttttttttaggagttcgggtcgtatattttttggatggttttttttcgagattttaatttcgttacgtttttttatcgttgaacgtggttagttcgagcgtagttatttatttagatcgtttttttttttagttcgggcgttgtttgggtggattgggggttgggatgaatcggacgatagcggcggaatagtaggagtcgagaggggtagagaggggtaggaattatagggttttagagggtatttgggtttcggatacgcggtcgtttagggttgtgtttgatttagtggaggtggttcggtcggtggttttagaaagggggagggggtattttttttcggcgtggttttcgtaggttaacgggtttaattgtttggggcgaggtcgtggagattcggattggcgtcggcgttagttggagggagacgttttcgggtaagaggtggtattttttttttttcggggggggttttcgaggtggtttttggtgagggggaggcggtggtttgaggttttcgttttttaagttatttggaagtgttttttatttatttttagttcggagaatattatgttttttgtagtaatatggttgtagttgaaagttattattataaataattaatgtagaaatagaaagttaaatattttatgtttttattatagggtgggggttaaattttgggtatatatggatatgaaaatgagaatagntnttggggattttaaaaggagggagggagggagaagggtaaggattaaaaatttttttattgaatattatgtttattttttgggtgataggattaatagaagttttaattttagtattatgaaatatattttttttttttttttttttttttttttgagataaggttttgttttgttgtttaggttggagtatagtggtatagttatggttttttgttgttttgattttttgggtttatgtagtttttttattttagtttttaggtgtatattattatgtttggttatttttaaaaattttttttggtagatatggggttttattatgttgtttaagttggttttgaatttttggttttaagggatttttttgttttggttttttaaagtgttaggattataggtttgagttattgtattcggttgaaatatatttagaaataaatttgtatatgtattttttgaaattaaaattaaaataaaaaagaatttaatttgttatagagttttagttattttttatattttttttgaaaaatttatatatatatattttttatttattatgttaaagtaaaattttatatgtaatatataaatagaaaagtaaaatatatatagaaaaacgtatagtttataattggtgaattttagaaatagaatatatttttgtaattagaattagattattttaggattttagagattttttgggatttttttttagttattagtttttttttaaagtgtagtgaatttttgttttttaatatttgtttgttaacgtttttaggattagttttgtttgttttagtttaatgtatttttaaagtttataaagatgtatgtgtaagaacgtttattgtaatttcgtttatgatagtaaaagatggaaaagaatgaaaatgtttattaataagagattgagtaaatttattatagttttttttataataaaattttatgtaattattaaaagtaaagatttagatatgaatttattaatatggaaagatgtttaagatatgttagtaaagtagaaaattaagttttatatttgtttatttatattttatttatgtaaaaaaattcgtattgatttgtgtgtttgtaaatgtatagtaaatatgtgtttattgtttataattgggagaagggaatgggttaggaagggtggaaattgcgtttaaaaaatatgggtatttattttttataaggagtatgtatttattgtggaattttaaaggtaatttaataattaagaaaaaaatttataatatttgaaatttgtttttggtgttaacgcggttgaattgaaaattgtatttatttattaatgaatttttattggtttgtatttattaaattgataaatgtgtattttgtttgatatagagattttttttttttgggtatttttaaagtagtttttgtgtatatatattagaaggtattagtgaagatagttattgtttgtaagagcgaaataataggaataacgttagtgtttaattatagaggaagagttaagtaaattatgatgtagttatttattaaataatgtagtagttaaggagaatgagtggttttatttattagtatgaataggtttttaagataaatttttgagtgtaaaaagtaaggtatcgagtattgtgtaaagtattataatttttttttggttatgtatatatatgtatatagggtatatgaaaatatttagaaggatgtattttaatttgatgtttattttattagtttaggaggtggtgagtttaatgtgtaaggttttagtttgagggttgaaggtagttaggtgtgagtttgaaataatatgaatttttttttttttgagtatggattttttgttcgttatggtatgtaatttttagaggtttagagaagggaagggatttgtgtcgggttatatagagggtaggtggtcgagttgggattagttttaggtgggtttggttttaaagttcgtgtttagtttatttttttttggggtaggtgacgtggaggtttaggggagttggagggatttagtggggagggggaggggttttttttttatcgggttttttgtttgggtttagaatttttttttttattttgttgagtaatttgatggggtgaagagtatttttaggtttagggtatagatatgttggggggtttttttttaggtttttttttttcgcgtttgttttagatttgttttattttttgatttgtggaagtttttgtgggtttggtgtatggtagtttttttgcggtgttttttttttcgcgtttcgcggcggtttagtatttgatgatcgttaaaaaaataaaaaaaatgggggtgagggaaaaaaanatcgtattgttgcgggaggnttggaaaaatttttaattttttttttttgtttttttaataggttttatgaatgtttttggttatattttttttttgtttatgtgtgagggttttttatatgtttggaaaaggaatggttgggtcgtgtggtattttaatttttagatttgttagaaataggtaaattattttgtaaaatagtttttttttttatatttttggtaatagggtaagggaatttttgtttttttatgttttagttagcggttggaatttttttttagtttttttttttggtaaatttttttttatttttattttgtagttaaaaagtttttattgtgtattttaatttcgtttttttatataggatatatatatgtgtgtgtatgtatgtgattgtgtatatatttttttatttatttatttatttatttatttatttatttatttatttatttattatttatttgtttatgtaattttaataggaattaaagggtatattatgaaaattttttttttatttttgtttttagttatttaaaattaggttttaaatttaggtagaatgttaattattgtttatagttttttttgttttttatttaaagaaattttgttaatatgtaagtaaatgtatatattttttttttttattttagtttttaattaagtggtaatatattattgttatttttgtattgtatttttatttttatttaaattttattttgggataatgtcgtattagtatgtaaaaaattatttttttttttaatatattttttttttttttttttttttggttttttttttttttttttttntgatagtggtataattttttatttgtagataaatattttttgtttttaaatttttgttataatttatgaggttgtggtgaatttttttatatattttttagatgtaaagtatatatattagatgaagttttatgagtggaatttttagtttaaagcgtaaatgtatttgtatgtttgatagcgttttgttgtttattttaatttaagaatgtattagtggacgtttgttttaggtcgttttttttatgtttttaggaatataatgtattatttagtgttttgatatttgttaatattaataggtataaaatggtattttaaagtgtttttatttttaaaatagttttattgtgatataattgatatattataaagtttatttgttttaaaggtatattttaataagttttagtaaatttatagggttataattatttttttaatcgaattttataatatttttttttattttaagtattttgatatgggttaaatttttattttttttgagtga

SEQ ID NO: 55 - DNA, 7802 bp, Artificial Sequence
  chemically treated genomic DNA (Homo sapiens)
tggaatgggaagggatttttttttttttaggtttagttcgttagggtttcgggtcgtgttgtagtttttggtttttggtgtcgtttttcgttttttagtttcgtagattttcggttttttttttgtttgcgcggtcgggatcgtttaggtaggcgtcggggtttcggggtttcggggggagggattcggcggttcggttcggtttcgttttttttttttgtttgtaaatatttgttgtttcgttggaaattcgacgatttcgcgcgcgttttgtttgtaaagtttttaagtaaatacgtttaaatgatcgtttcgggcggttcgaggtacgtttttttttttttcgcgggattagtaattttaggatttcgatttcggggtttcgttttgtttgttatttaggtcgggtagcgcgcgggcgttcggggtcgtttttttcggtatttcggtttcgcggagttcgtttggaagcgtcggttgtttggttttggtgggtggttcggtcgcgagtattttcgcgttttgggtttgtagttttagggttgagttttagaaagtcgcgttttcgttttgcgttatggtttttgttttttgtattcgattgggtttttttatttttattgggatagggttttttcgtttttgggagggcgggtgggagggatttgtacgtgggtatgtgtttgggggtgtgtgtggtagtttaatttttatcgagtggagaaagttcggttttattttttattttttttttaagaggatatatatatttcgtttaatttgacgtttaaagtagtcgtttttaggtttggggtttcggataggttaagtcggttgttgtcgattcgtacgtcgtttcgggtttcggtttttttttaggcggtggtcgcgtcgtcgtttgttcggttgcgggatgtttgtttttaaggttttaggcgtttaggttgatcgttagttttttattttggtgagggaggttttgcgttttgtagaagtttcgggttttgcggcggcggcggcggtatttttttggtcgttttttcgtttttttttattcgagtttcgtcggttgttttttgggaggaaggggattcgttagattaggtcgaggtttaggtatttgggagggggtcgcgttaggtttgcgggaaggcgtttaggttttttcgtaggaggttaggattagttttgtggcggtggtatagggagaattaggattattttttttttttattttcggttaggatttttttttttttttttcgttcgttaagggaggaggaagttcggtttgtttttgtcggcgaggcgggttaggtcggcgtttggtttggttcggattttcgtagttcggtttttcgttttaggttacgcgtcgtagtttttttagtttcgtttttttttttttttttttttcgtgggtttcgaggtcgatttcggtttttttttttcggtattttttttttatttttttttttttttcgttgttttgtgtttcgggtttcggggttgggttcgtgacgttaaatttagtgtggcgtcggcgagattggtcggcgcgggttattaaaagagtaacgtttttttttttaattatttattgttagttcgggaattggggcgggtcggttgggaattaaatgttaaatattttttatcggttggttttattattcgggatatttagttttaggttttttatttttttttgttagttttaaattatttagattaagaagggttttcgagattttttatttttttaaaggtgggggttgtttttttttattttcggttagttcgatttggtgttcgcgattgaatttaaacgaataatttttatttttttatttaaaattagcggataggcgtttttgtatcggaaggtttttttattagttttttttttttgtttttgaaataatttttagttttagaagttagtatttttaagatttggtattcgtagcgtttttgacgcggggattttttttttcggttttgaggttttcgcgcgtagaatttatggtagtttttggttttacgcgtggttgtgagttgggtttacgttgcgtggcgtatttatttttcgattgacgcgcggagaagtattttttatttttttttttagtttgtatttttaaattttaatttcgggttttttagtaaaaatgcgtgtgtattcgtttttttttgtttatggagaggttttcggtgaatgttagatagtaattaaataattaaaaggtttagagagcgttgtgagtaggagaagatgcgggtagtttggttggtttaggagagacgagtggttagagaatgaaaggaaaatcgatgttttttaattgggtcgtttaataacgggagattaagtgggtttaggagaaacgtggcggggggggggggagttttttttaaaaaattggggttttttttttttgttttatatatggaaatttagttttgattttaaataaatattagatttaagaaggtgaggattttaaagaagatttaaacgcgagattaggaagatttacgtttttattattttttttaatatattttattaatttttttatagggatagtgttttaaaatacgacgatttttatatattaaggtgaagttgaatattgttgttgtttttttatcgtatgaaaggaattttttagaatttatttttagggacggttttttttatttcgaatttttgtatttgtagggaattttatggggtagaggagcgaagagggaataatgtttttaatttaaataaaattttaaattaagtttttagttttatcggtgggatagtttgcgggggaatttatttttttttttggtagtattgttttgggggcgagtagagagtggatttggagtttttttttttcgtttgatttttgttcgttcgagtagtattttcgggttagcggttgtagttattcgggcgtcgttaggggatgtagtggtttaaaggatcgagcgggcggtgtaggttggaattcgcggggcggattaatcgcggttcggttatagtttcgttcgttgattggtttttttaggtttcgttttcgttcgtttcgtttttttcgttggggcgtttcggagtcgcgtgtttttcgtttcggggtgtttattgcgtagagcgtggtttggagattcgcgagtcggggaaggtcgtcgtggagtttcgattagaggtcggggttggggtcggtgtagatcgagggttggtttttttgattgtgggagaaacgtcgggagtcggagtaagtagggtttcgggcggggcgaaaggaaaagttgggtttttagagtgaagatcgagttttttttgttcgtttatattgagcgtattcggggaatgagttagagttagtttttttttttttttttttttttttattttttattgttgttatttaagttaaaagtatatattgattataaatattaggtttggaaagggtagttgtaatagttgaagcgtgtttattttgggggtttgagagcgtagaaggttcgggaaagaggtgataatgataataaaattgacgcggacgttttagttaaaggtattttttttttattcgatgatttatttttttaggaagtcggttcgagaggtaaattttaaaatattttgatatgaaatattttgtttttttgattaatttaacgcgtacgtttttttatatcgatgcgtttttttaaatattttgtattagattttaataatgatttatgcgtgtttattttttaaaagtttgaaaaagaaaattttgtttatcgaaatgaattttatgaatggggtaggttggttgtatcgggacggaatcgtttattcgattcgaatgaattggtaggagtcgcggttatatttaaagggttagagcgcgcgttttttttcgttcgtttttaagtttcgcgggtttcgtttattttgttcgtcgttttttcgtcggcggtcgttttttgcggcgttttttttcggttagtggaggggcgggaggaggggcgggggtgcgcggggcggggggagaagttttggagcgggtttgggttgtagtttttttgtgtcggggattttgttttttattcgttagcgttaggtttttttttttcggcgcggatgatattagaatttttttaagttgcgtcgcgttatagttgtttgcgaatattgagttgtttggcgtcgttttgatatttttagaaagaatgtattttttgtaaaaaaaaaaaaaaaatattgagagagggagagagagagagaagaagagagagagacggagggagagcgagatagagcgagtaacgtaatttgatcgagtaggtcgtacgtcgtcgttttttttttttttttgtttttcgttatttaggttggtattggtgattttttttttttttaagtttgattttttgtttttaattatttgggaggatttaaattaattttaaaaatttaattttttttttttggaggttttttaggggttgagaggacggtttcgggatcggtgttttcgagggagggatttgttttttaagtcgtaatagttagttttgggatttgttttttaagttgtttagttagtttcggttttcgcgagtcgggttgtagggacgttttcgagagttttgcgggtttcgcggtcgtgttttcgcgttttcgtgcgggtttcgggtgcgttgggcgggcgggcggcgcgaggggaggttgtgttattttagtaatttaggggtttatttaggttttttatttttttttttgtaggtgattcgaggagggatttcgttttcgagcggttgaggatttcggtgtagaggagtttggttcgtagaattgtagagtcgtcgtttttttttataatttggtttcgttttattttgtcgtatttagtttttggatttttgtttttttttttttttttttgttaaacgatttttttaagataatttttaaaaaatttttttttttgtttatttttgttttttagtttttttatttttttatcgaaagtaaattatttaacgattttcgatttttcgacggtaggagtttttcgattttttaggcggatcgtttttttttttcgcgcgcgggtttcgggttcggcgagagggcgcgagtatagtcgaggttatggaggtgacggcggattagtcgcgttgggtgagttattattatttcgtcgtgtttaacgggtagtattcggatacgtattattcgggttttagttatttttatatggacgcggcgtagtattcgttgtcggaggaggtggatgtgttttttaatatcgacggttaaggtaattacgtttcgttttattacggaaattcggttagggttacggtgtagaggtatttttcgatttattacggtgagtgcgttcggggtgtcggggttttcgtcggtcgttttagtcgtttcggttcggggaggtcgggagggatttgagggcggggagaggttaagcgaaagtttttatttgtcgtttttggtttatttataaaaaaattggggttcggaaatgggcgaggaaggtttttggttcgtcgcgagagtgtgttttgaaagagtcgtagtaggcgtttttttcggttggtggttttggggtttggcgtttatttggcgggcgttaggtcgtagtttttcgtttttgcgcggttgtaggttttggggtggggggtttcgggatgtttttaagcgcggggtgttttggttttgttttcgcgggttcgggttttttgggttcggtagtcggcgtcggataagtacggttggaattcggtttttttaaaaaatttggcgttttttgttattcgttagttttttttaggcgggtgggcggggtggagggggttttttgttagcgttttttaattcgtatatttttagaaaggttttagagatttatttatttatatttttttttttgatttttttttagagttagtgtttttggtttttagataggttttttattttttggttttaggaatggaattttgatgttgaaggggtttgggggggaagatttttgttttaagtttgagggatttgagattttttagattttcggttgtatagaatttttttgcgtttttgtttttaagtcgtttttttgtttgtaatttttgttttattttgtttttgggtattgttttttattagttttttatttaagatgtaggatatattttcgtttaaataaaggtaattttagtattattttttttttttttttatttggagaagtttaggagagttttgaaatgtaaaaaaagaagattaggtttgtgtagtttgaggaaaaaagatcgaatattttttagttttaagtttgtttttaaagaagaaataggggtaaaatatcgggtagaaaaagtgtggggttttttgagtttagttagatcgaattttgttttgatttttttatttagagtttgttttgatacggatgatatagttttttcggtagtaggcgttttttattttgttgtcgttaggttttaaataatcgtttttgcggatggggcgttttttgtttacgttttgtgcggattagtagttaggtggaaatgcggtagaggtagatttaatattatttattatattattttttgtataatatgaattttgatttttggtgtttagagaattttttttttttttttatttttttttttttttttttttttaagattttagttttagtattgtttttaatggttgaatcgaatgttaaatgttgaggtaggtattggttttaaagattaagaagtgtgtggatttgtatttgttttttaaatgtattttttagagtgtatgagttatagttattttaagattgtgcgttttaaatgaaggttaattagattttgtgtttgagttattttttatttaaaatatatatattaattggaattttgtgttttaggggtttaggtgaaaatttatttatggtattggtgggattatagttttattgagggtgtatggggtttacgttattttttttttttttaggatttgggagggtgagaaaagtagagaaaatggttattttagggtttagttttgggaattttttttaatagttcgagtaatgaaaacgtttttgtaaattttattttaggttttttgcgggtagtttggtcgtttttgagtaagtattgggttaggttttcggaaattaattttgaaagttttttgatttttgttttaaggttttttttttttgtatttggtgttgggagttgggtttgattttagggtcgttttttggtgtggagtagttgtgtggtcgggttttattttttaggtttttttatttatagtcggtttttttattaggttggttgggattaagttcgagttagggaatttagggttattgaaggaaatttataaattaagttaggttttagagagagattttggggaatgtgatttaggcggtgtatttggagaggttaaataagtaaaggggtttttttttttttttgtagtaatttttcgggtgttagttataggttttttattttgttatatttgatgggatatttttgtgggagagatgggtgaaggattttgtttttagtttgatttttaggtgtgttaggtaggtatttcggggatcgttaggatgagagagtgggtttgagttcgggtttttgttgaaaaggaggtcgatgcgaggtagagattttttaggtgtttttgacggttttttagggttatatttatttttttttttttttttgtttttttttcgttgttttatagg

SEQ ID NO: 56 - DNA, 7802 bp, Artificial Sequence
  chemically treated genomic DNA (Homo sapiens)
tttgtggggtaacggggaaagggtaggagagagaaggagggtgagtgtggttttgggaggtcgttagggatatttggggaatttttatttcgtatcggttttttttttagtaaaagttcgggtttaggtttatttttttattttggcggttttcggagtatttgtttggtatatttgggggttaggttggggatagaattttttatttattttttttatagggatgttttattaaatgtagtagaatgaagggtttgtggttgatattcgagaggttgttgtagagggggagaagggtttttttgtttatttggtttttttagatatatcgtttaaattatattttttaaggtttttttttagaatttgatttgatttatgggttttttttaatggttttgagttttttgattcggatttaattttagttagtttgataagagagtcggttgtgagtgaggaggtttgaaggatggagttcggttatataattgttttatattagaaaacgattttggagttaggtttagtttttagtattaaatataggaaggagaggttttgggatagaagttaggagatttttagggttagttttcggaaatttaatttagtgtttgtttagaaacggttaggttgttcgtaaaaggtttaaaatgggatttgtagggacgtttttattgttcgggttgttggagaaagtttttaaggttggattttgggatggttattttttttgttttttttatttttttaaattttaaaggagaaggagataacgtaagttttatgtatttttaataaagttatgattttattagtgttatgggtgaatttttatttgagtttttaagatataaaattttagttgatgtgtatattttaaatgaaagatgatttagatatagagtttgattagtttttatttaaaacgtataattttaaggtagttgtaatttatatattttgaggggtatatttaaaaagtaagtgtaaatttatatattttttgatttttaaagttagtatttgttttagtatttgatattcgatttaattattaagaataatattgaaattaaaattttaagggagaggaaggggaggggagtggagagggaaagagagttttttgaatattaagggttaagatttatattatgtaggaagtagtatagtaaataatattaagtttgtttttatcgtatttttatttaattgttgattcgtatagaacgtgggtaaagagcgttttattcgtagaaacgattgtttaaaatttggcgatagtagggtagaggacgtttgttgtcggaggggttatgttattcgtgttaaggtaggttttgagtaggggaattagggtagaattcggtttggttggatttagaaagttttatattttttttgttcgatgttttatttttgttttttttttaggaataaatttagagttggaaagtgttcgattttttttttttaaattatataggtttggttttttttttttatattttagaatttttttgaatttttttaggtgaaagggagaaagaggtggtattggaattgtttttatttaaacgggggtgtattttatattttaggtgggaggttaatggagggtagtatttagagatagagtaaggtaagagttgtaggtaaggaggcgatttgaaagtaaagacgtaagaaaattttgtgtagtcgggaatttgggaaattttagattttttaaatttaagataggggtttttttttttaaatttttttagtattagaattttatttttgaagttaggaggtaagagatttgtttaaaaattaaaggtattagttttgggaaaaggttaaggagaagggtgtgaataaataggtttttggggtttttttgaaaatgtgcgaattgagggacgttggtagagggttttttttatttcgtttattcgtttagaaagagttagcgggtaatagggaacgttaggttttttggaagagtcgggttttagtcgtgtttgttcggcgtcggttatcgggtttagagagttcggattcgcggaggtagagttagggtatttcgcgtttggggatatttcgagattttttattttaaaatttgtagtcgcgtagagacggagggttgcggtttggcgttcgttaggtgagcgttaggttttagggttattagtcgggagaggcgtttgttgcgatttttttaaaatatattttcgcgacgagttagaggtttttttcgtttattttcgggttttaatttttttgtaaatgaattaggaacggtagatgggggttttcgtttgattttttttcgtttttaggtttttttcgattttttcgagtcgggacggttgaagcggtcggcgggagtttcggtatttcgggcgtatttatcgtggtgggtcggagggtatttttgtatcgtggttttgatcgagttttcgtagtagggcgggacgtggttgttttgatcgtcgatgttaaaaagtatatttatttttttcggtagcgggtattgcgtcgcgtttatgtaggagtggttgaggttcgggtggtgcgtgttcgggtgttgttcgttgagtacggcggggtggtggtggtttatttagcgcggttggttcgtcgttatttttatggtttcggttgtgttcgcgttttttcgtcgggttcggaattcgcgcgcggggagggagggcggttcgtttgggaggtcggggggtttttgtcgtcggagggtcgggggtcgttgaatgatttgttttcggtggggggatgggaaggttgggaagtaaaggtgagtaaaggagaaggttttttaaaaattattttggaggggtcgtttagtaaagagaagaaggggaagataaaaatttaaaaattgggtacggtagaataaaacgggattaggttgtaaaaaggggcgacgattttgtaattttgcgagttaggtttttttgtatcggggtttttagtcgttcggaggcggagttttttttcgggttatttgtaagggagagaatgggagatttggatgagtttttgagttgttggagtggtataattttttttcgcgtcgttcgttcgtttagcgtattcgagattcgtacgggagcgcggggatacggtcgcggagttcgtagggttttcggggacgtttttgtagttcggttcgcgggagtcggggttggttgagtaatttggagggtaagttttagggttgattgttacgatttggagggtaagtttttttttcggggatatcggtttcgggatcgtttttttagtttttagaaaatttttaaaagaggagagttgagtttttaaaattgatttaggtttttttaagtggttgggggtaaaaaattaaatttaaaaaaaaaaaaagttattagtattaatttgggtagcgaagagtagagaggaggaggaggcggcggcgtacgatttgttcggttagattgcgttgttcgttttgtttcgtttttttttcgttttttttttttttttttttttttttttttttttttagtattttttttttttttttatagggaatgtattttttttgaaagtattaagacggcgttaggtagtttagtgttcgtagatagttgtggcgcgacgtaatttaaggaggttttagtgttattcgcgtcgggggggaggagtttggcgttggcgagtaggggataggattttcggtataaggaaattgtaatttaaattcgttttaggattttttttttcgtttcgcgtattttcgttttttttttcgtttttttattgatcggaaaggggcgtcgtagagggcggtcgtcggcggaggggcggcgggtagggtgggcgaggttcgcggggtttgggggcggacgggagggaacgcgcgttttggttttttaaatgtggtcgcggtttttgttaatttattcgggtcgggtggacgatttcgtttcggtgtagttagtttgttttatttatgaagtttatttcgatgggtagaatttttttttttagatttttaaaaaataggtacgtatggattattattaggatttaatgtagggtgtttgggagagcgtatcgatgtggggaaacgtgcgcgttaaattgattagaaaaataaaatgttttatgttaaggtattttgagatttgtttttcgggtcgattttttaagagggtgagttatcggataaaggggagatgtttttgattggagcgttcgcgttaattttgttgttattgttatttttttttcgagttttttgcgtttttaagtttttagagtgaatacgttttagttgttgtagttgttttttttagatttaatatttgtaattaatgtgtgtttttgatttgagtggtaatagtgagggatgagaaggggggaggggaggaagagattggttttaatttatttttcgagtacgtttagtgtagacggatagaaagaattcggtttttattttagggatttaattttttttttcgtttcgttcggagttttatttatttcggttttcggcgttttttttatagttaaggaaattagttttcggtttgtatcgattttaatttcggtttttggtcgggattttacggcgatttttttcggttcgcgggtttttaggttacgttttgcgtaatgggtatttcggggcggagggtacgcggtttcgaggcgttttagcgagaggggcggggcgagcgggggcggggtttggagggattaattagcgggcgaggttgtggtcgagtcgcgattggttcgtttcgcgggttttaatttgtatcgttcgttcggttttttgagttattgtattttttagcggcgttcgggtggttgtagtcgttggttcgaaaatgttgttcgggcgagtaggggttaggcgggaaaagaagattttaaatttattttttgttcgtttttagggtaatgttgttaggagagggagtgggttttttcgtaggttattttatcgatggggttgagagtttaatttggggttttatttgaattggagatattgtttttttttcgtttttttattttataaaattttttataaatgtaaaaattcgagatagaagaagtcgtttttgaaagtaagttttgaaggattttttttatgcggtgaaggaataataataatatttaattttattttggtgtgtgagggtcgtcgtgttttaaaatattatttttgtagaaagattagtgaaatgtattggaagaagtagtggaaacgtgaatttttttggtttcgcgtttggattttttttggagtttttatttttttaaatttgatgtttgtttgaaattagggttgaatttttatatataggatagaaagaaagaattttaattttttaaagaaagtttttttttttttcgttacgttttttttgagtttatttggtttttcgttattaggcggtttagttaagaggtatcgattttttttttattttttgattattcgttttttttgggttagttaggttgttcgtatttttttttgtttatagcgttttttaaattttttaattatttagttgttgtttaatatttatcggaaatttttttataaataaggagaaacgaatgtatacgtatttttgttaagaagttcgggattaagatttaaggatataagttgaaagaaaaaatgaaaaatgttttttcgcgcgttaatcgaggggtggatgcgttacgtagcgtgagtttagtttatagttacgcgtaagattaaaagttgttatgggttttgcgcgcggagattttagagtcgaagagagaagttttcgcgttagaaacgttgcggatgttaggttttgaaaatgttgatttttgaggttaagaattattttaaagataaaaagaaaagattggtgaggaggtttttcggtgtaagggcgtttattcgttaattttggatggggaagtagggattattcgtttaaatttaatcgcgagtattaagtcggattggtcggggatggagaagggtaatttttatttttagaaaaataaaagatttcgaaggttttttttggtttgggtggtttgaggttggtagagaggggtggggggtttggggttggatgtttcgggtaatggagttagtcggtagggggtatttagtatttaatttttagtcggttcgttttagttttcggattgatagtgggtaattgggagagaggacgttgtttttttgatggttcgcgtcggttagtttcgtcgacgttatattgggtttgacgttacgggtttagtttcggagttcggagtatagggtagcggggaagggaaaaggatgggagggggatgtcgaggagggagggtcgaggtcggtttcgggatttacggggaaggaagggggaagggagcgaggttggagaggttgcggcgcgtggtttgaggcggagagtcgggttgcgggggttcgggttaggttaggcgtcggtttgattcgtttcgtcggtaagagtaggtcgggttttttttttttttggcgggcgggggagggaaagggggattttggtcgggggtaagggggaaaggtggttttgattttttttgtgttatcgttataaagttgattttggttttttgcggagaagtttgagcgttttttcgtagatttgacgcgatttttttttaggtatttgggtttcggtttggtttagcgagtttttttttttttaaggagtagtcggcggagttcgggtggaggaaagcgaggaggcgattaggaggatgtcgtcgtcgtcgtcgtagggttcggggtttttgtagggcgtaaggttttttttattagggtaaggggttggcgattaatttggacgtttgggattttgggagtaagtatttcgtagtcgagtaggcgacggcgcggttatcgtttagagaggagtcggggttcggggcggcgtgcgggtcggtagtagtcggtttggtttattcgaaattttaggtttggaagcggttgttttaggcgttaagttgagcggggtatgtgtgtttttttgggaaaaaggtgagaaatggagtcggattttttttattcggtaggggttaagttattatatatatttttaaatatatgtttacgtgtaagttttttttattcgtttttttaggggcgaagagattttgttttagtggaagtggggaaatttagtcgggtatagaaagtagaggttatggcgtagagcggaggcgcggttttttggggtttagttttagggttatagatttagggcgcggagatgttcgcggtcgggttatttattagagttaggtaatcggcgtttttaggcgagtttcgcggggtcgaggtgtcgggagaagcggtttcgggcgttcgcgcgttgttcgatttgggtaataggtaaagcggagtttcggggtcgaagttttaaagttattaatttcgcggagggggagagagcgtgtttcgggtcgttcggggcggttatttgagcgtgtttatttaaagattttgtaagtagagcgcgcgcgaaatcgtcggatttttagcgaggtagtaaatatttgtaggtagaagaaagaagcggagtcgagtcgagtcgtcgagttttttttttcggagtttcggagtttcggcgtttgtttgggcggtttcggtcgcgtagatagaaaagaagtcgggaatttgcggggttggggggcggggagcgatattaaaggttagaaattgtagtacggttcgaggttttggcgagttgggtttgggggaggagaagtttttttttatttta

SEQ ID NO: 57 - DNA, 6385 bp, Artificial Sequence
  chemically treated genomic DNA (Homo sapiens)
  unsure (5467)
gttatagtattaataagtaatagaattgaatttaaaatgttttgttttaattattaagtgttgttttttttattttttagagaaaagttaagaatataggagattgtttatatgagttgatatgtaatggttttgataggttttattgggattttttatttatttaaaaattaaaaaattatatagttataaggtttttagaattgattaagttttgttttcgttttatttggtaggtgttgtttaatgaggttgagtgatttgttaaaggttattttatgagtttatggaaaatgattaatgttatttttaaaaattagttaaaagtattttttattaagtttatttttatggtttattttaagtaggttaataagtatattaggtatagtttaaatttaattgagtaaatgttgatattagtttatagatttagtagataagtagtaataaggaattatttattttttatttattatttagtttttttaaggtgtaagttataaagtgaagtaaatagtagtttaagagttttttatatacgtgagattaaaatagtgaaaaataaattgatttttaaagttatatatttataatgcgtttatgtttgaggttttttgaaatatgaaaaagaataatatttgggaatattttttgtattttagaaataggtatattttttatatagagttttatatttgatttttagatatatttaattattaatttatttttttgagtatgtattgtgtatttattttgtgtagattattgtaggggattatagaattattaaaggatattttagttattaagaattttttaaatttattgaggtgataaaataaagtatatatgtatgtatgcgcgtgcgcgtatgtatatatatatatatatatatatatatatttgaattttaattttataaatttttgtgtggggacgttatatgatgtttagagttagtgggtgttaggggagtgtgtgtatggggataggagggaatggaaagattgtttggtgtgagtaggggagttataattaggaatatatgaggaggtggttttgcgcgtttagttgtattttttttttttgtttaaatattattggagaaaattatttggttttaatttttttagttagatttttttttttttgttttgttatttaggttggagtgtagtggtacgattatggtttattgtaattaggtttaagtgatttttttgttttagttttttgagtagttgggattataggtatttgttattatatatggttaatttttttatttttagtagagaaggggttttattatgttggttcggttggtttcgaatttttgattttaagtgatttttttatttcgatttttcgaagtattgggattataggcgtgagttattacgtttggtcgttagttaggtttttaaattattttaaagttatgattataattttaattagtttgtgtttatttaaatgtgtttttttatgtaagagaaattatagatagtaagttggatatggggtttatgatttaaatgtagattaatattgagaaggaaggtaaatttttattaatataaaattttatttaatttaatttggtagttttttgtgtaatttaattttttatggtattgaatttagggttgggtatagtggtttaaatttataattttattatttttggaggttgaggaaggaggattgtttgagtttaagagttgaaggttatagtgagttatgattatgttattgtattttagtttgggtaatagagtaagattttgtttttatagaaagtaaaatgataattaaaaaaaaaaaagttgggtatggtggtgtatatttgtagttttagttatttagaaggttgaggaaggcggagtgtttgagtttagaagtttaaggttgtagtgagttatgattatagtatcgtattttagtttgagtattagagtaaaattttgttttaaaaataaaattaaaaataaaataaaaaagatattatttttaatattttttttaatgataatagtatttattaatggttggtttaatgattaatatttggttgggtgtagaggtttacgtttgtaattttaatattttgggaggttaagggcggtggattatttgatataaggaatttgagattagtttggttaatatgatgaaattttatttttattgaaaatataagattagttggtgtggtggtaggcgtttgtaattttagttgttcgggaggttgaggtaggagaatcgtttgaatttgggaggtagaggttgtagtgagttgagattgtattattgtattttagtttgggtaataagcgtgaaattttatttttaaataaataaataagtaaatgtagattaatatttatagatatttattaggttttttttttatacggttgtattgttttttttatgtaaagtgattttaggtgttttgagttttttgttgtttgggttttgttttttagttaataaatttattgagtgttgtttgtaggtttaggtagtggtggagattttatagaagtttagttttttttatattttagttttatatgcgtgatttgttttatttatttattagttaataaatatttttttttattttttgtgagtttggcgttggttaggttgtaaagatataaaatgaatagaagtgttttcgaattttagtaatttagagtttgttaggggagggaatacgtggatgtgtatttttaggggtaggggatttgaagcgtaagggggcgaaagtgggttttacggagtttttaggatatcgaaattggtttgggcgtttgaagttaaggttaggttttttgggtaaggtagatttgtggtattttaaaggatgagtaggcgtttgttgtttataggaaggttattttgagtttaggatttagtttgaattaggttgttttgtagtttcgagtggagggcgcgaggtaggaatgtaagtagaagtacggcgttgagggatgttagaatgttggaaaggtgagtaggattcgagtagtattttagatatagcgttttggttatggtataagaaggcgtaagtttttggttgttggttttgttttgtatttaagtagggtgatgagcgtttttcgttgagttatttattttttatcggagaaggaattttggttaaaatgaagtcgtacgttataggttagttttggaggatttatgtggtgtgtttcggtagtagggtacggcggttgtgtggtttgagtttaaattgagggttaagaggggataaaatttaagttaattttagtttttaaatttggagttttgttttgggaaggaagaggagtgttcgtttgatttagaaggttaagtattttgtaattttgttttttttttgtattttttttaaaggtggtgggatgatataggattataatatagataattataggggataatattatgatgtaaggatggattgttagattttgtagggtggatttatttattttttaggaggtgtagaggtgaagaggaagggtttagattaatcgattttttttttttatttgaattttttttattttgatttattattttttttttaattttaagtttaatttttattttttaaataggttaaaaaatatttttttgagatagatttttattttgttgtttatattggtttttaatttttgggtttaagcgatttttttgttttagttttttaaagtgttaggattattggtgtgaattattatattttatttaaataagttttttaatgtgaaaaattttaaatataataaaaatagagagtagaatatttattttttagttttgataaatattattttatgattagttgtttaatttatatattatttatttttttttatatagtgttaatttataaatatttggattttatttttggtttttttttttttaattataaataaaattttgttaggttgttgttttgtgtaaagtttgtttttgtttttttaaggataatttaaagttttttttaggttagtttttttattttttttggggagagatggggaatagaggagatgagagattttttgggttttaggtattttgtattaacgttaaatttttggatttataaaaatatgtttgtagaataaggtaatattaaagttttttttgataagtaatataaaaattattgattaagattataattaataattgtatattaaagattcgggaagtttttggtttttggggcgtttttttttaggtttgtttgggtcgtttgatttaacgtttggataaaataaaggtttttgtttttcggtatcgcgcggttttcggagttgtatttttaaattttcgtggcgattttatttgaagcgtggaagaagtaattacgtaagtggagagtgggttttgaaagttttgggatgaattattttttttttttttgtcgttttttttttaggatttcggttgcggcgaggaggaaggagttagtttagtagtttttgcgtttgtggtcgcgggtgttttggaggtttttcggtgtgacgagtgggggattcgaaggttcgtgcgttatttttaggtttggacgttgtttttcgttttttgtttttaataggtgcgtcggatttttaggttttggggtgaatttagttgtttttatattagttttcggaattattaaaaatttaaattgggatttttcggagtaaataagagtttagagttttttgtttaatgttggatttaatacgtatatatttttaagcgagttggtttttttttttttgatttttgattttcgcgatagttttttttacgtatattatcgttgttgtcgtcgtttttttttttcgcgtggttttttgatttgcgagggagagagaggatatcgaagtcgggagttcgtagggattatgtattagagtttggttatggtcgttaattacgggtcgtttttcggtgtttacgaggcgggcggtttcggcgtttttatgtacggcgcgggcgtcgcgttttcgttagtttacgtgtttatatcgcgggtgttttttttcgtgttgggtttgttttatttttagggcggaggcgcgggttttgcgttcggaggcgtttcgggcggtagtttcggtggggtcgcgtttggtgcggggttcgggatttagtagggtagttcgggatggagttaggcgggagtcgacggagtcgtttatatttcgtcgtcggtgtcgtcgcgtttttttttttcggggattatcgggtttttggcggtcgtcgtcgtcgttgtcgcggttcgggaagttgcggtttatagtagtggcggcggagcggcgggtgcgggtttggcgggtcgcgagtagtacgggcgcgtcggtttcgcgggtttttattttagtttttattcggtttatatggtcgacgtgggcgcgttttgggtcgtagncgttttcgttttcgtcggatatttcgaggattagttttttttttttttttttttttttttttgagacgtagttttgttttgttattaggttggagtgtagtggcgcgatttcggtttattgtaatttttgtttttcgggtttaagcgatttttttgttttagtttttttagtagttgagattataggcgcgcgttattacgatcgttaatttttttttttttttttgtattttagtagaggcggggttttaataggttggttaggatggtttcgattttttggtttagttttttttattttaagttagaggttttagagggttttggagaggatttcgtaagcgcgtaaggttagggcgtcgcgtttcgtttcgtattttcgtttgcgggttttattgtgtggttatgtcgtcgcgttatttcgtaaaagtcgcggcgaggttcggtcgggtttttttttttttgggggtggtcgtttggtttttttaagaggggtgagggggaggggaatattaagagttatagatcgggtttcggcgttatttttagggttaattagtttgtcggcgatgtgtatttggttgtattttcgggaattttttttggttatttagggttagaggataatttaaaagcgttttaaagtttaggtttttttcggagttagtttaagattggaaatttggtaggggtagtttttattttttaaagtgagaataaatgtagaaggatttagtatttagtaggtggttaataaacgcgagttttgttttttaagtttgggtttttttttttttatagggtgggtttaatttaaatttattttttcgttttttttcgaaattttagaggtcgtttgtattttgaattaggggttgttatttttttttttttttcggttcgtgtatttaggttttt

SEQ ID NO: 58 - DNA, 6385 bp, Artificial Sequence
  chemically treated genomic DNA (Homo sapiens)
  unsure (919)
aggggtttgagtatacgggtcgggggagaaagggaagtggtaatttttagtttaaaatgtaaacgatttttggaatttcgggaagagacggaggagtgagtttggattgagtttattttgtgggggaggggaagtttaggtttgagaagtaaagttcgcgtttattgattatttattaagtgttaaatttttttgtatttgtttttattttgaagagtaaaggttatttttgttaggtttttagttttgggttggtttcgagaagggtttaggttttgaagcgtttttaaattgttttttggttttgggtggttagggaaggttttcgggggtgtagttaaatatatatcgtcggtaaattgattaattttgaaagtggcgtcgaggttcggtttgtggtttttggtgttttttttttttttattttttttgggggagttagacggttatttttaggggaggaggggttcggtcgagtttcgtcgcgatttttgcgagatagcgcggcgatatggttatataatggagttcgtaggcgggagtgcggggcggggcgcggcgttttggttttgcgcgtttacggggttttttttagggttttttggggtttttgatttaaaatagggaggattgggttaggagatcgagattattttggttaatttgttgaaatttcgtttttattaaaatataaaaaaaaaaaaaaaaattagcggtcgtggtggcgcgcgtttgtagttttagttattggggaagttgaggtaggagaatcgtttgaattcgggaggtagaagttgtagtgagtcgagatcgcgttattgtattttagtttggtaatagaataagattacgttttaaaaaaaaaaaaaaaaaaaaaaaaaggattggttttcgaagtgttcggcggaggcggaggcgnttgcggtttaggacgcgtttacgtcggttatgtaagtcgggtaggggttggagtaggagttcgcgaagtcggcgcgttcgtattgttcgcggttcgttaggttcgtattcgtcgtttcgtcgttattgttgtaggtcgtagtttttcgggtcgcggtagcggcggcggcggtcgttagggattcggtggttttcgggaaggagaagcgcggcgatatcggcggcggggtgtaagcggtttcgtcggttttcgtttggttttatttcgggttgttttgttgggtttcgggtttcgtattagacgcggttttatcggagttgtcgttcgaggcgttttcggacgtagagttcgcgttttcgttttggaggtaggataggtttagtacggaggagggtattcgcggtgtgggtacgtagattggcgaggacgcggcgttcgcgtcgtgtatgaaggcgtcggggtcgttcgtttcgtaggtatcggggggcggttcgtggttggcggttatggttaagttttgatatatggtttttgcgagttttcggtttcggtgttttttttttttttcgtaggttaaggagttacgcggggagagaaaacgacggtaataacgataatatgcgtgggaggaattgtcgcgaagattaaaaattaaaggggaaaaaattaattcgtttaaaaatatatacgtattaaatttagtattgagtaaagggttttaggtttttgtttatttcggaaaattttaatttgaatttttggtggtttcggaagttgatgtaggagtagttgaatttattttagggtttgaaggttcggcgtatttattgggggtagaagacggagggtagcgtttaggtttggaggtggcgtacgagttttcgggttttttattcgttatatcgagaggtttttaggatattcgcggttataggcgtagaagttgttaggttggttttttttttttcgtcgtagtcggggttttaaaagaggaacgatagaaagagagagggtggtttattttagagtttttagaatttattttttatttgcgtggttgttttttttacgttttaaatgaagtcgttacggggatttgggggtgtagtttcggaggtcgcgcggtgtcgggaagtaggggtttttgttttgtttaggcgttgggttaggcggtttaggtaagtttggggagaggcgttttagggattaggggtttttcgggtttttggtgtgtagttattggttgtgattttggttaatgatttttgtattgtttgttaggaaggattttaatgttattttattttgtaagtatatttttgtaagtttaaaagtttggcgttaatgtagagtgtttgggatttaagaaattttttattttttttgttttttatttttttttaagaaagatggggagattggtttagaaagaattttagattgtttttggggggataaggataaattttatataaaataataatttaataaagttttgtttgtaattaaaaaaaaaaaaattagaagtagagtttaaatgtttataagttaatattgtgtgggggaaagtgagtaatgtatagattaaatagttggttatgaaatgatatttgttaaagttgagggatgaatattttattttttatttttattatgtttgaaattttttatattaaaaaatttatttaggtggggtgtggtggtttatattagtaattttggtattttgggaggttgaggtaggaggatcgtttaagtttaggagttagagattagtgtgggtaataaagtgagagtttgttttaaaaaaatgttttttaatttatttaaaaggtagaaattgaatttaaaattaaaggaagggtgatggattaaagtgagagaggtttaaatgagaaagaaagatcggttgatttgagttttttttttttatttttatattttttgggaggtaggtgaatttattttatagggtttggtaatttatttttgtattatagtattgttttttgtaattatttatattgtaattttatgttattttattatttttagagaaagtataagaagagggtagaattataagatgtttgattttttgggttagacgaatatttttttttttttttagggtagggttttagatttggggattaaaattggtttgagttttgtttttttttggtttttaatttgaatttaaattatatagtcgtcgtgttttgttgtcgaagtatattatataaattttttaaaattggtttgtagcgtgcggttttattttaattagagtttttttttcgatgggaaatgggtgatttagcgggaggcgtttattattttgtttgggtgtaaaataaaattaatagttaggagtttgcgtttttttatattataattaaagcgttatatttgaagtgttgttcgaattttgtttatttttttagtattttaatattttttaacgtcgtgtttttgtttgtatttttgtttcgcgttttttattcgggattgtagaatagtttgatttaagttaagttttgggtttagaatggtttttttataggtagtaaacgtttatttattttttaggatgttataagtttgttttgtttaggaagtttggttttgattttaggcgtttaggttagtttcggtattttaagggtttcgtagaatttattttcgtttttttgcgttttagattttttgtttttaagagtgtatatttacgtgtttttttttttagtaagttttaagttgttgggattcggagatatttttgtttattttgtatttttatagtttgattagcgttaggtttatagggaatggggagaagtatttattggttggtggatggatgaaataaattacgtatgtggagttggggtgtgaagggagttgaatttttatgaaatttttattattgtttagatttgtagataatatttagtgggtttattaattgaaaagtaaagtttaagtagtaggaaatttagagtatttgaggttattttgtataagaaaaataatgtagtcgtataaaaaaaaaatttagtaagtgtttataaatgttagtttgtatttatttatttatttatttagagatggagttttacgtttgttgtttaggttggagtgtagtggtgtaattttagtttattgtaatttttattttttaggtttaagcgatttttttgttttagtttttcgagtagttgggattataggcgtttattattatattagttaattttgtatttttagtagagatggggttttattatgttggttaagttggttttaaattttttatgttaggtgatttatcgtttttgattttttaaagtgttgggattataggcgtgagtttttgtatttagttaaatattagttattaagttaattattaataaatgttattattattaaaggaaatattgaaaatagtattttttttgttttatttttggttttgtttttgaaatagggttttgttttgatgtttaggttggagtgcggtgttgtgattatagtttattgtagttttgaatttttgggtttaagtatttcgttttttttagttttttaagtagttgggattataggtgtgtattattatatttagtttttttttttttaattattattttattttttgtaggggtagggttttgttttgttgtttaggttggagtatagtggtatggttatggtttattgtagtttttaatttttgggtttaagtaattttttttttttagtttttaaaaatggtgagattatgggtttgagttattgtgtttagttttggatttaatattataaagggttagattgtataggaggttgttaagttgaattaagtggggttttatattagtgagaatttgtttttttttttagtattaatttatatttaggttatagattttatatttaatttattgtttataattttttttatataggggggtatatttagataagtatagattaattggggttatagttatagttttagaatagtttaaagatttagttgacggttaggcgtggtggtttacgtttgtaattttagtatttcgggaggtcgaggtgggaggattatttgaggttaggaattcgagattagtcgggttaatatggtgaaattttttttttattaaaaatagaaaaattagttatgtgtggtgataggtgtttataattttaattatttaggaggttgaagtaggagaattatttgaatttggttgtagtgagttatgatcgtgttattgtattttagtttgggtgatagagtaagaaaaaaaagatttagttgagggagttgggattagatgattttttttagtgatgtttgaataaaaagaaaaaatgtagttgggcgcgtaaggttatttttttatgtgtttttagttgtggtttttttatttatattaggtaatttttttatttttttttgtttttatgtatatatttttttgatatttattgattttgggtattatataacgtttttatataaagatttatagggttgagatttaagtgtgtgtgtgtgtgtgtgtgtgtgtgtgtatgcgcgtacgcgtatgtatgtatgtgtgttttattttgttattttagtaggtttaaaaagtttttgatggttggaatattttttagtaattttataattttttatagtggtttgtatagagtaggtatatagtatatatttaaaagaatgaattaatgattgaatatgtttgaaggttaaatatagagttttgtataagaaatgtgtttatttttgaaatgtaaaaaatgtttttaagtattatttttttttatattttaggagattttaggtatagacgtattataaatgtatagttttgaaaattaatttgttttttattgttttgattttacgtgtgtggggggtttttgaattgttatttgttttattttataatttgtattttggaaaggttggatgataaatgagagatgaataattttttattgttatttatttgttgaatttataaattggtgttagtatttatttagttgggtttaagttgtgtttggtatatttattaatttgtttaaaataagttataaaaatgggtttggtagaaggtatttttaattaatttttaaaaatgatattggttattttttatgaatttatggagtgatttttggtaaattatttaattttattgggtaatatttgttaaatgaaacgggggtagggtttgattagttttaggagttttgtagttgtgtaattttttgatttttggatgagtaagggattttaataaaatttgttagagttattatatattagtttatgtagataattttttgtatttttggtttttttttggagggtgagggaggtagtatttggtagttagagtaaggtattttgagtttaattttgttatttattagtattgtgat

SEQ ID NO: 59 - DNA, 8513 bp, Artificial Sequence
  chemically treated genomic DNA (Homo sapiens)
tagatggtgaaatttgagttgatggggaggaggatttttattttttgtaggggtttgatgggtagtatagttggttaattttgggatttagagggtaggtcggttggttgattattaggtttggaagatttaggtagttggttttaaagaggttttaggttagtagttagatatgagttgtgagggttaagtatagttatttattagatgatttatttttagtttttttgagttttagataatagaagataggtggttgtatttttggttaagggtaggtgtggtagtggtgtttgttgttattgtgtttttattggtttttagtaattagatttaatagacggagtaattgttattcgaggtttttgaattagggttatttattaggagtatgcggttttttgatgtttagttttggttggtgttgttgtgggtattggtgcgagtataggggatagggtttgtgtgttttttttgtgggggttttaaattggtattttaagtagaacgagttttggtgttggagttagttaagtagtaaattttggatgggttgtatttgattagtcgttttagaataatttattttttattttaggtagcgttgattagagtttttcggagattatagttagggagtgtggttttagggaatggggaggaggttattagttttgttattgttataggtgggtgagggagagagtaataggtaaagagtagatagggaaagggaggtagaaggggagtttggtaggagtagtagagggagtggggtgtggtaggagaaggaggagttggggtagggattggttgtagaggatataaagtagtttttatttttttagaggtaggttcgagggagagtagtgggtagggtttggggagttttagaggagagttttatttttatttatatttttttttttttttttgtttttcgggtagattttattttagtttatagttttttgtttattttttatttgtttatttttcggttttattatttgtattatgttcgtttgtggttgtacgtgttttttattttttttggtattttttgtttgaggatttttcgatggggattaaggaggaggcgttaagggtttcgtatttttttggttgagtattatattattaatttgggttggtatattttaattttgttttttagtggtttgaggggtgagaagtttggtgttttgaaattgtaattagattgtagatttttagaaggtaatagtatagttattggataatcgaggcggtttttggatatagtaggatattagtagttttttttagagtttaagattcgagttaatgagtttggagtaggtcgggttaggaggaggatttttatttgtgagtttgcgatttttttatgttgtaggcgagattattacgtagatttttaggaattgggatggcgggattggatattgtagttcgaggggtattagttgaattattgtagtgggtagtgttttttttatttggttggtagtttaggtattgttgtttttttttattttgtcgtttttagtttttttaaagttaataatttttggtttgttagtattttttgttgtgtttttattgttcgaaggttttttttttttttttatttggattataatggtaatgtggttaagacggatgtgttagatatggtggtggaggtttgtggttgtagttagtaagaggatttggggttttggagtgaagagattaagatgaagttttttaggtatagggtatttgtgattggaggtattagatttttgatttatattttaatttaataattatttggtaatatgatttatttgatttttatgggatttaaatgggtatttttttgtttgagattttggtttattttaggttggttgatgtgttgggagatgggtaaagcgttttttttaaaggggtttatttagaaagtatgattttttgttttaagttttgtgagaagatgttagggattagggagggagggagggaaggtagagaaaaattatttagttttttttaagatgagaaagtttttaagtgaggggaggaggaagtagatagatggtttagtaggtttgaagtagggtaagtaggttggtttagggtaagggttgttgaggtattttaagggaaggttaagagggagatgggtaaggcgttgagggaggatgtttaggggatttttagaaataggagttaggaaaatgaggtattaagtttaagaagttttttggttttttttaggggataggatttattgggagataagtatttatattttttttttttttttttatttttttgagatcgagtttcgttttgttattaggttggagtgtagtgatacgattttggtttattgtaattttcgttttttgggtttaagtgatttttttgttttagtttttcgagtagttgggattataggcgtttattaatttttgtatttttagtagaaacgaggttttaatatgttggttaggatggttttaattttttgattttttgatttattcgatttggtttttcgaagtgatgagattataggcgtgagttatcgcgtttggtttatatttttttaataaaaaggagaaagaaaattaataaatgtgagttataaagaagggttagggtgatggtttagagtaatagttttttaagtgtattttgtaggtttttgggaggtttttttttaggggtgtttataaagttaaagttatttttataataatattaatatgttatttgttttttgaatttttattattttaaaattgtattgtggagttttttagaggtcgtgtgatatgtgattatattatttttttgatattattgttaatggaatgtgtgtttgtatggttttgtgttatagttttttttagttttaatttttaatgtggtgaattgatagatgtaaattatatgaataaaagtttaatgatttttttttttttgagacggagtttcgttttgtcgtttaggttggagtgtagtggtataatttcggtttattgtaatttttattttttaggtttaagcgatttttttgttttagttttttgagtagttgggattataggtttgcgttattatgtttagttattttttgtatttttagtagagatggggttttattatgttggttaggttggtttcggatttttgatttgaggtgattcgtttgttttggttttttaaagtgttgggattataggtttgagttattgtgtttaatttaatgatttttaagagtatagaggaaattaaaaagtttgagatttattggtttatagaattgggtggggagaagaaagtaaggtgttttaagagagttttttttgttgggtatcggtggttttagttatttaggaggttaaggtcggaagatcgtttaaatttaggagttcgaggttatgattatatttgtgaatagtttttgtattttagtttgggtaaatagtgaggtttcgttttaaataaaaataaataaatatataaatatataaatagtttttttggaagaaggggttcgaggttgggataggagtatgtgtggggtgttttttttttagtgtttattagtttggtttgattgagttgggtttttgatttttttggggataattagtttgggttaaagttttagatttttttttatttttattttttttttttttttttgatttttagattgaatagttaatttattgattttttatatttaagggggtggtttttggaagtagagttaggatgtgggaggtttgtttgtggggttgaaaaaaaggggagagggtgttttttttttttgttatgttttttttttttttttataaaaattagagattgaaatgttgttttttttttatattcggttacgatggtaatgtaaatttaaagaggtagggtatttttttgttaggtagtatcgttgggtatagtaatttttgttttttcgttttttagagtttatatatttattttttgggtttttaagtgggttttagtgaggggttttttttttaattgggttttttttttagttttttagtttttttgtttcgatttcgagcgggtgttatgtgtgagaacggttagtagagggagtagaaagtttggaagagtagttagagtttgtagtgacgtggtgcggaggggcggtattttttagaatttcgagacgtagagtcggggttttagggaaaggggttttagttttagggttttttggtgatttcgtgaattatattttgtatttagagttttagtcgttgttttttgtttttatgttttatagattttttatttttttttagagtttttaatttaatttgatttgttttaaatcgtaattttgtttcggtcgttgtaagttttatttaaagggtgaggtttgtagataaattataggatggtagaatgtttagttagtattaattaaaggcgattattttatttttattattatcgttttcggttgaatttttttttttgtttcgtaatattttttttaatttggttgtcggggtttttttggggtagtcgatttagaaatttaagtcgggatttagtatttattaatagtagcgtgtttagtcggggcgcgggggggggcgtaacgagtatagggttttttaagggagggggaggattttgggggttttgggggtgtaataagttcggtatttttttttttgtttttagttatttcgttttattttttagaacggtaagagggagggaaatagaagggaggtgaggggcgagcgggaagagcggcggcgcgttagcgttggagagagaaaaagtttttgtaaaagggaaaaaaaaagtttgcgtttttcgcgggtggttcgggtttgcggcgcggttgggtcggcgggagggttgggggttaggttgggggggtgggggtggtatcgaggttgcgttgtcgtggtttttttcgttttttttttttatcgtatattttttagtttagattttagttttggatcgcgtatttcgagtttagcgtttagatagaggtgagaagggggggtaggcgggggattatttgggagtagtgggggagggggtttgaggggatgtttagttttttagggatttattttagattcgggatatagaggtaaaataggggtgggagagtttggggtgagatattagaaattttagattttttatttgtgtttttttttgtattttttttttttttttttttttttttttgttagtttgtgtatttttgttttagggaatcgtgggtttttgttttcgttttttttatatattagaaatattttatttttatgcggttaagtttaagaggttggagggatggttagttggaggtttgcgttgtagagaggtaattttaggtgtgtgtttgcgcgtggggtaggaagatgttagtgtttttgaaaggtggggattgtaaaggagggagttttaggtggggtggggacgggtgtgtgggaggtaatagagttattaggggttagttaggtttgaatttttgatttgttttgtgatagatgtgttagtggatgtttgtgttttaggggaaaggagtgttttttggatttggaagggggttggggcgggggggggttgtttaaggtttagtgaaggttttagaatgattttatgtaatttggatttttgagttttaagggttgtgggtaaggagtttaggaggagtcggggagattttgttttgattttttgattttaggattatcggggtagcgggagttagtcgtaggagatttttatcggggttgggcgggattattggttattgttagtttgtgtattttcgttggtatttcgtttaaacgggagttggggatcgaggttttttttttggtttagattattttgtttgtttttgtttttcgttttgaatttttttttaggttttatgatttcgaaataattagtattgggtagttagttttcgggataggattacggaaaggggatttcgtagagtttggggattgagggttttaggggtttggagagttggggttttttaggataggtttttacgttttagtagagggagaaggcgggcggtttttcgggggatatgtaagggtcggaataagtgtggttttttttagggggcggggtttagagatttttttttttttattattatttttttggtattttcgtttttgacgttattagggggttttcgggggtttggaggggttaatttttgggaagtcggttgttataattagtaatttaaggtgttcgggtttttttttttttttatatatatttaattttattgatttagttattttttttgtttttttttttttatattttttggatttttttttttttttaattttattaacggggatttttattttttagtagtgtttttttgggcgttattgtttgtttttcggatgtgttgagaggaggagggaagaatgtggttcgttttttagtttttatttttatggttcgttttattgggttttcggggcgggtggggggagcggagtcgtttgtagttagtgtttgcggcggcgatttgggtgggtcgaggaggtacgggggcggggaaggcgggatcgggagtaggggggcggagtcgatttttgggagttggggagcgggggtgcgagggggacgttggaaaatagggagatatcgaagatggtttagggtttcggtaggggaattttagagttttttgttttatttcgaatttttatattttagaaaaattttatcgaagttaaaaaagttggcgatattttttttttattagtttgaaggggagatatgggtgggttgtggaacgcgtgggcgaggaggggtgtagttttatttttttggaggtttttcggtagttaggtagtggggtagaaagatgattgagtaggtaagtttgggggagtttttagtgtttgggggattatttgtaaattttttttttttttttgggtgagttatagagggaaggaggcgggagaattgtttttttatttagttgttaattagttgtgtttttcgttttttatattagttttaaggtcgagttgggaggttttggatgcgggattcgtatttcggttggaaaaggaggagttagaaaagggtatagtttaggttgtcgggtcgggttgggtcgcggggttcgggtttcgttttttattttatttcgtttttattttaaattttagtatttcgggattatttatcgcgtcggtcggttcggttcgttttcggtggttttttattttatttcgttttattttatttttattttcgggagattggaaaattcgggatggagttaaaattggagtttgaaaagaaaaacggatagtagtattttttttttcgttacgtttttataaggattatattgttttttttatttttttagagtttttttttatatttttttttttgtttttttaaaatagagattaaaaagattaggtgggtttgatttaaattattttagaataatattagtttttatttttgtgtttaatagatttagaagattttttttaggaattttatttttttttttatattgttttttgtttaagagggtagatggtttgtgtttttttttggttttatttggttttgtgtcgggattgtggttagggttttttttgttggatattgtagagattgtatacgggttgtttttggggaggggtacgagaaggaagggggaacgggttttagtagagtcgtttagtgtttgaagttagatttattatacgagtttttttattttatttttaaagtcggtttagggttatagtaagaagaattagagggtttatgttattaaaattatttgaagttaatataggtataattagtttaaaatatgttttttatatatagattatataggtaaagtttttatttaggtaaagtttttatttagtttttaagaagatttttagagtatatagattataagattgtttttgtttttttgggatattatttttttttatttttttttttatttagcgagtgatgttttttttgttttgagacggagtttagttttgttatttaggttggagtgtagtggtattatttcggtttattgaaattttcgttttttaggtttaagcgatttttttgttttagtttttcgagtagttgggattataggtattcgttattatgattggttaatttttgtttttttgtagagacgggggttttattatgttggttaggttggtttttaattgattttaggtgattttttcgttttagttttttaaagcgttggaattataggcgtgagttattgtgttcggtttagtgatgttttttttaattcgaatttcgtggtagatgttttagaggggtgggggatattagggatgttttgtttaggattttgtgtttgagattgttgtttgatagtttttattttttttatttttatatttattttttttttttgtagt

SEQ ID NO: 60 - DNA, 8513 bp, Artificial Sequence
  chemically treated genomic DNA (Homo sapiens)
attgtagaaagggaaggtaggtataaaggtggaggaaatagagattgttagatagtagttttaggtatagaattttgggtagaatatttttggtattttttatttttttaagatatttgttacggaattcgagttgaaaagagtattattgagtcgggtatagtggtttacgtttgtaattttaacgttttgagaggttgaggcgggaggattatttgaggttagttgaagattagtttggttaatatggtgaaattttcgtttttataaaaaaataaaaattagttagttatgatggcgggtgtttgtaattttagttattcggaaggttgaggtagaagaatcgtttgaatttgggaggcggaggttttagtgagtcgagatggtgttattgtattttagtttgggtgatagagttagatttcgttttaaaataaaaaaagtattattcgttgagtgaggggaggggtaaggggaaatgatgttttagagaggtagaggtagttttgtagtttgtgtattttggggatttttttgggaattgggtgggagttttgtttgggtgggagttttgtttgtgtggtttgtgtgtagaaggtatgttttggattaattgtgtttatattaattttaagtgattttagtaatatggattttttaattttttttgttgtaattttgggtcggttttgagggtgggatgggagaattcgtgtgatggatttgattttaagtattgggcggttttgttagagttcgtttttttttttttttcgtgtttttttttagggatagttcgtgtataatttttgtagtgtttagtagagggagttttagttatagtttcgatatagagttaggtggggttaggagggagtataagttatttgtttttttagatagaaaatagtgtggaggaggaggtaaggtttttgaggggagttttttgggtttgttgggtataaaggtgaaagttggtgttattttggggtagtttaaattaggtttatttaatttttttggtttttgttttgggggaataggaaaggaagtatgaggggagattttgagagaatgaaaaaaataatgtgatttttataaaagcgtagcgaggaagaaggtgttgttgttcgtttttttttttaaattttagttttgattttatttcgggttttttagtttttcgggaatgagggtggggtggggcgggatggggtggagaattatcgggagcgggtcgggtcggtcggcgcggtgggtgatttcgggatgttgggatttagggtgagggcggggtgagatggggagcggaattcggatttcgcgatttagttcggttcggtagtttgggttgtatttttttttaatttttttttttttaatcgaggtgcggatttcgtatttaagattttttaattcgattttggaattaatgtggggggcggggggtatagttggttggtagttggatggggggataattttttcgtttttttttttttatgatttatttaggggaaggagggaagtttgtaaatgattttttaaatattagagatttttttaaatttgtttatttagttatttttttgttttattgtttagttgtcgaagagtttttaaggaaatggggttatattttttttcgtttacgcgttttatagtttatttatattttttttttaggttagtaaaaggaaaatgtcgttaatttttttagtttcggtaaagtttttttggggtgtgagagttcgggatgggatagggagttttagggtttttttgtcggagttttaaattattttcggtgtttttttgttttttagcgtttttttcgtattttcgttttttaatttttaggagtcggtttcgtttttttattttcggtttcgtttttttcgttttcgtgttttttcggtttatttaagtcgtcgtcgtaggtattggttgtagacggtttcgttttttttattcgtttcgggagtttagtagagcgagttataggggtgggggttgaggggcgggttatattttttttttttttttttagtatattcggaaagtaggtagtggcgtttaggggggtattattggagagtgggggttttcgttggtggggttagaaagggagaagaatttagaaagtataggggagagaaagtagagaaagtgattgggttaataaaattaggtgtgtatggggaggaggaggggttcggatattttaggttgttggttatagtagtcggttttttaagggttaatttttttagattttcgggaattttttggtgacgttaagggcggggatgttagggagataatggtggagggggagaggtttttggatttcgttttttagggaaaattatatttatttcgatttttatatatttttcgggaaatcgttcgttttttttttttattggaacgtaaagatttattttagaagattttagttttttagatttttaaaatttttagtttttaggttttacggggtttttttttcgtaattttgtttcgaaagttagttgtttagtgttgattgtttcggggttatgggatttgaaagaggatttagagcggggagtaagggtaggtagggtggtttgagttagaggaggggtttcgatttttagttttcgtttgggcggggtgttaacggggatatataggttggtagtggttagtggtttcgtttagtttcggtaggggttttttgcggttggttttcgttgtttcggtggttttgaggttagagggttaagataaggttttttcggttttttttgagttttttgtttatagtttttgggatttaggagtttaaattgtatggggttattttagggtttttattagattttggatagttttttttcgttttagtttttttttaagtttagaagatattttttttttttaaagtataagtatttattggtatatttgttataagataggttaaaggtttaagtttggttggtttttagtggttttgttgttttttatatattcgtttttattttatttggagtttttttttttgtagtttttattttttagaaatattgatatttttttattttacgcgtagatatatatttggggttatttttttataacgtagatttttagttagttatttttttagttttttaaatttaatcgtatgaaagtaagatatttttaatatatgggagaggcggagataaagatttacggttttttgagatagagatatatagattgatagaagaaaaaaagggaagaaaaagaagatatagagaaagatataagtgaaaaatttggagtttttaatgttttattttaggtttttttatttttattttgtttttatgtttcgggtttgggatgagtttttaagaagttgagtatttttttaggtttttttttttattgtttttaggtggtttttcgtttgttttttttttttatttttgtttgggcgttgggttcgggatgcgcggtttagggttggagtttgggttggggggtgtgcggtggggagggggggcggagagggttacggtagcgtagtttcgatgttatttttatttttttaatttggtttttagttttttcgtcggtttagtcgcgtcgtaagttcggattattcgcgagaagcgtaaatttttttttttttttttgtaaaaattttttttttttttagcgttggcgcgtcgtcgtttttttcgttcgttttttattttttttttattttttttttttttgtcgttttggaggatgaggcggggtagttggaagtaagagaaggggtgtcgggtttattgtatttttaggatttttaggatttttttttttttttgagggattttatattcgttacgttttttttcgcgtttcggttgaatacgttgttgttggtgagtattaaatttcggtttggatttttggatcggttgttttaaagaggtttcgataattagattgaggaaaatattgcggggtagggggagaagtttaatcgagaacgataatagtggaggtagggtagtcgtttttggttggtgttaattgagtattttgttattttgtggtttatttgtaggttttattttttggatggaatttgtagcggtcgggatagagttgcggtttggggtaaattaagttgggttgggggttttggaagaaggtgaggagtttatggagtataaaagtaaggagtagcggttgaggttttgggtgtagggtgtggtttacgaggttattaaggagttttgggattgaagtttttttttttagaatttcggttttacgtttcgaagttttggagggtgtcgttttttcgtattacgttattgtaggttttagttgtttttttaggttttttgttttttttgttggtcgtttttatatatgatattcgttcggagtcgaagtagaagagttggggaattgaaggaggagtttagttgaaggaggagttttttattaaagtttatttaaaagtttaggaggtggatatgtgagttttgagaaacggagaggtagaggttgttatgtttagcggtattgtttgatagggaagtgttttgtttttttagatttgtattgttatcgtgatcggatataagggaggggtagtattttagtttttgatttttatgagaaagaggaggaagtatgataaggaaaaagggtattttttttttttttttttaattttataggtagattttttatattttagttttgtttttaagaattatttttttgggtgtggaaggttagtgggttaattgtttagtttgagggttaagggggaaaagaaaaggtgaaggtagggggagatttgggattttgatttaggttagttatttttagaggggttagagatttagtttagttagattagattaatgggtattgaaaaaaaggtattttatatatgtttttgttttagtttcgagtttttttttttagaggagttatttatgtatttatgtatttatttatttttatttgggacggggttttattatttgtttaggttggagtgtagaggttatttataagtgtgattatagtttcgaatttttgggtttaagcggtttttcggttttagttttttaagtagttgggattatcggtgtttagtaagaagagtttttttagaatattttatttttttttttttatttagttttatagattagtgagttttaaattttttggttttttttatatttttaaaagttattaggttaggtatagtggtttagatttgtaattttagtattttgggaggttaaggtaggcggattattttaagttaggagttcgagattagtttggttaatatggtgaaattttatttttattaaaaatataaaaaatagttgggtatggtggcgtaggtttgtagttttagttatttaggaggttgaggtaggagaatcgtttgaatttgggaggtggaggttgtagtgagtcgagattgtgttattgtattttagtttgggcgatagagcgagatttcgttttaaaaaaaaaaaaattattgagtttttgtttatatgatttatatttattaatttattatattagaaattaaaattgaaaaagattgtaatataagattatataagtatatattttattaataatgatgttagaaagatgatgtaattatatgttatacggtttttggaaaattttataatataattttaagataatgagaatttaaaaggtaaataatatgttagtattattatgaaaatagttttgattttgtggatatttttgaaaagggattttttagaagtttatagagtatatttgaagaattgttgttttggattattattttaatttttttttatgatttatatttgttgatttttttttttttttttattaagaaagtataagttaggcgcggtggtttacgtttataattttattatttcgggaggttaagtcgggtggattaagaggttaagagattgagattattttggttaatatgttgaaatttcgtttttattaagaatataaaaattagtgggcgtttgtaattttagttgttcgggaggttgaggtagaagaattatttgaatttaggagacggaggttgtagtgagttaagatcgtgttattgtattttagtttggtgatagagcgagattcgattttaaaaaaataaaaaagaagaaagaaagtataaatgtttgttttttagtgggttttgttttttgggaaaaattagggaattttttaggtttagtgttttatttttttgatttttgtttttgggggttttttaagtatttttttttagcgttttgtttattttttttttgatttttttttaaggtattttaatagtttttattttgggttagtttgtttattttgttttaagtttgttggattatttatttgtttttttttttttttatttgaggatttttttattttgggagaggttaagtaatttttttttgttttttttttttttttttttagtttttgatatttttttataggatttagggtaggaaattatgttttttgggtagatttttttagaagaaacgttttatttattttttaatatattagttaatttggaataagttagagttttagataagaaagtgtttatttgggttttataggggttaagtgagttatattgttaggtggttgttgggttggggtgtggattaggaatttgatgtttttagttatagatgttttgtgtttgggaaattttattttggtttttttattttaaagttttaggtttttttgttagttgtagttataggtttttattattatatttggtatattcgttttgattatattgttattatgatttaggtagaggagagagaggggttttcgggtagtagggatataataggaggtattggtaggttaaggattgttggttttgaggaggttgaagacggtagaatggaaagaggtagtaatgtttgggttgttagttaggtggggagggtattgtttattgtagtaatttagttggtatttttcgggttgtagtatttagtttcgttattttagtttttggaagtttacgtaatggtttcgtttgtaatataagggggtcgtaggtttataggtgggggttttttttttggttcggtttgttttaggtttattggttcggattttaagttttaggaagggttgttggtgttttgttgtgtttaagagtcgtttcggttgtttagtaattgtgttgttgttttttaggggtttgtagtttagttgtagttttaggatattagattttttattttttaagttattagagggtagagttaaggtatgttagtttaggttggtgatgtggtgtttagttaggagagtgcgggatttttggcgttttttttttggtttttatcggaagatttttaagtaaagagtgttaggaagggtggggagtacgtgtagttataggcgggtatggtataggtggtgggatcgaggagtggataggtgaaaagtgagtagggagttgtaggttgaagtggagtttgttcgaaagatagaaaagggaaagaaaatgtgagtagagatgaagtttttttttgagattttttaagttttgtttattgttttttttcgaatttatttttagaaaagtagagattgttttgtgttttttgtaattagtttttgttttagttttttttttttttgttatattttattttttttgttgtttttgttaggttttttttttgtttttttttttttgtttgttttttgtttgttgtttttttttttatttatttgtgatagtagtaaagttgatgattttttttttattttttggagttatattttttggttgtagttttcggagggttttggttagcgttgtttggggtggaggatgagttattttgggacgattggttaggtgtaatttatttaggatttgttgtttggttagttttagtattagagttcgttttgtttggggtgttagtttggagtttttataggagggatatatagattttgttttttgtgttcgtattagtgtttatagtagtattagttagagttggatattagggagtcgtatgtttttggtgaatggttttggtttaggagtttcggatggtagttgtttcgtttgttgagtttgattgttgggggttaatgagggtatagtgatagtagatattattgttatatttatttttggttaagggtatagttatttgttttttattgtttgggatttaggaaggttgaaagtagattatttgatggatagttgtgtttgatttttatagtttatgtttggttattgatttggggtttttttagagttagttgtttgggttttttaaatttagtggttagttagtcgatttattttttgagttttaggattggttagttgtgttgtttattaggtttttgtagggggtggaggtttttttttttattagtttaggttttattatttg

SEQ ID NO: 61 - DNA, 5327 bp, Artificial Sequence
  chemically treated genomic DNA (Homo sapiens)
aaggtaaataattaaaaaataaataaattttttttttttaaaaaagaaaaaaaattgtagtttttaaattagatttaatggtatagatttgtaattttataattttaggtatttagagtaaaggtagaaggatcgtttgagtttagtagtttgaggtagtaatgttttgtgattgtgtttgtgaataattattgtattttagttcggaaaatagtattagatttttgttttttttttttgtttgttttttttttttgttttttgtttgtttttttttttgtttgtttgagataaatgatttttatgttttagtttttcgagtagttgggattataggggcgtattattatatttggttaatttttgtatttttagtagacggggttttgttatgttggttaggttgattttaagtaatttatttgttttttaaagtgttggggttataggtatgcgttatcgtatttagttaagataaaattgtagtttttgttaatgatttgttagttattgtaaattataaaaggttatgtattgttttatagtataaattaattttaaatttaaaagttaaaaaaaaaaaaaggagtttattcgagcggaatttatttataatttttgaggttttatgaggaagatcgaggattttaaaaggtatttgtggttttgtggtatttttttgatattttttcgggagttttagaagttattagtagtgttttttaggtttttttgttagttgttagaattgttaaaagataaaattataatgaatttagtttataaattttttttttttttttttttgagatagagttttttttcgtcgtttaggttagtatgtagtggcgcgattttagtttattgtaatttttattttttaggtttaagcgatttttttgttttagttttttaagtagttgggattataggtgtatattattatgtttagttaatttttgtattttagtagagatggggttttattatattggttaggttggttttgaatttttgattttaagtgatttgttcgtttcggttttttaaagtgttgggattataggcgtgagttatcgtatacgttttttagaaatttttttttttttgttttttgagatagagtttcgtttttgttgtttaggttggagtgtaatggtacgatttcggtttattgtaatttttgtttttcgggtttaagtaatttttttgttttagttttttgagtagttgggattataggtatgcgtattatgtttagttaattttgtatttttagtagagagggggttttttatgttggttaggttggtttcgaattttcgattttaggtgattcgtttatttcggttttttaaagtgttgggattataggtttgagttattgcgttcggttttagtttttataaattttaattggtttttattttttattttagaatcgggtaatattttattttatagagtgagtgttttgatgagttgagtaaaggaggttgggtttgtagatagaaaagggttaaggaaagtagaaatagagaatataaagtagattggttgttttaggtattttttttataaaggttaaagtaaaggggttttttttattttgttagttaatattagtttgtttgaggatttggttattatttgttttttttgattatttagaaggttaaataaatttagttttagtttggttttgtggaaggtgagtaattgtattttggtttggttttttgggtatagtagaagagtttagtttaaattaatggttttttataatttaattttatttatttatttatttttgagatagggttttattttgttatgaggatggtaggtgttattttggagtgttggagtgtagtggtgcggttttagtttattgaagttttaattttgtgggtttcggttttagggttagtttgtgttgtgagagagcgtgtgattttttgggattataggtaggtgttattacgtttagttaattttttgtatttttagtagatacgggatgtcgttaggttgtttaggttgttttttattatttatatttttgattataaagtataggatttttgtttatttaggtttttaatttatttagatttttatgttatagatgatgattgttgttattaagaaaatgagggtaagagtaaatataggtagagtttttaatatattagtaatttgttatttgtagtgatgatttgttaggaagggttaatttatttttttttttgaaagggaggtttacgaaaagaaaaataggttaggtgtggtggtttatgtttgtaattttaagtattttgggaggttgaggtaggaggattatttgaattcgggaggttaaggttagtgtgagttatatttttattattgtattttagttcgggtaaaagagtaaaattttgtttttatataaataagtaattttaggatttttaaattttgtagatgaagaaattttttttttttttttggttggggtggggaagattagtttgttttttgttttttttgggaagttataggattattgatgaataaaattattgtttagggaagagatatttagtggtttttatgtttaggtttatttttaggaattatatttttagaggggttttaatttttgaggttttaattggtttttttttaggtatttaagaataaattacgaataagtagtgggaaataaaaattagtttgattttagtatttgtttttattttaaagggaggtgagggttgttggtattggtgggttttgggtttagtttttagttagaggatgtggggattttttttgggggtttgttttttttatatttttttttttagttaggttgttttggatatttttgggatttttttgagggattatggtttttgttttggggtttttttttgttattttaatattgaggtattttagtttttttttttggaagatggagtatttgtattgttgtttttttttttgtttttgtttttgtataaaaatgataatatttttcgtcggattgtattttagtttaaaaaataaaattaaatttttttttttttgatattttaggtttatagagttaagtttattaattttttttttgttttttgttttttggttggggaaagggttttttaagaaatattgaattttttttatttaaaagtagtttaggttaaataagttaaattttaaatgtaatatttattgttttaaaatattttagtaaagaaaataaggtttggaagatggtggtaggggatagatgaaataagattgaaaagtgttgataatttatgaagttttggaaatttattttgtttttttgtttgatattttttatagtaaggagtttttaaaaatattagtttttttttattttttattttaataatttttttttgtttgtttttgataagttttggtttaggaggagaaaagttgtataattagtttttgtgtatgtgtgtgtaaatttttgtgtgtttatttgtgaatatagttttattaggggagggtttatttttgttatgtattattagtatataataaatatatatgtttttttttatttttttagagatagggttttattttgttatttaggttggagtttagtggtggtaattatagtttattatagtttttattttttgggttgaagtaatcggttttttaagtagttgggattataggtttacgttattatatttagttttatttattttttgtatagacggggtttttttatgttgtttaggttggtttggaatttttgggttttagtgatttttttattttagttttttaaagcgttgggattataggtatgagttattacgttaggtttatattttattttaaaataacgaagttttttttttttatatattttaaattcggggggtattaaatttttgatattattttaacgatttttttataattaaggtattataattttttttagaaagggttttttagttatttatattacgggtttcggtggtatagcgtagggtagtatagatttgtgttatagttttcggttttatttagagtaggatggttttaatttaatttttttgtttgtttgtttggagatggcgttttattttgtcgtttaggttgtagtgcggtggtacgattttggtttattgtaattttcgttttttgggtttaagcgatttttttgttttagttttttgagtagttgggattacgggtattcgttattatattcggttaatttttgtgtttttagtagagatatagttttattatgttggttaggttggttttgaattgttgattttaggtgattcgttttatttcggtttattaaagtgttgggattataggcgggagttatcgcgttcgatttaattttttgtattttagtagagacgggattttatcgtgttgtttaggttggtttcgaatttttgattttaggtagtttattcgtttttgtttgttaaagtgttaggattataagaatgagttattacgaatgagttattgcgttaggtttttagttttatttattttgggttttagtttttatcgtttgaaaaaagagtagttcgattgtatttattttttcgggtttcgtttaaattatgggtagtttcgtttaaattatgggtagtttcgtttaaattatgggtagtttcgtttaaattatgggtagtttcgtttaaattatgggtagtttcgtttaaattatgggtagtttcgtttaaattatgggtagtttcgtttaaattatgggtagtttcgtttaaattatgggtagtttcgtttaaattatgggtagtttcgtttaaattatgggtagtttcgtttaagggcggagattgggcggagcgtcgcgtttttttttattttttttcgattttcggaggttttttatttagtgttcgcggcgtatgtgttaggtatattttatttttaatcggttttggattttattttcgttttattatcgttgttggagtagttgtttttaggttttgcgtcgttttcggagtttatggtcggtacgcgttgggtattcggggcgttgtttcggggttgcggttgtaattgtagtagttgtcggcgtatcggcgtcgtttgtttgtttttttatttcgtcgttggttttatttcgtcgggcgtttcgggtcgtcgtcgtttgttgttgttgttcggggtcgtcgcggtcgttgttttttagacgcgtggtttttagatcgggtttgtgtttttcgggaggttggcggggtttttcgttgtggttatttttgtcgcggtcgcggtcgtcg

SEQ ID NO: 62 - DNA, 5327 bp, Artificial Sequence
  chemically treated genomic DNA (Homo sapiens)
cggcggtcgcggtcgcggtagaggtggttatagcgggaggtttcgttagtttttcgggaggtataggttcggtttggaggttacgcgtttgggaggtagcggtcgcggcggtttcgagtagtagtagtaggcggcggcggttcgagacgttcgacgggatagagttagcggcggagtagaagggtaggtaggcggcgtcggtgcgtcggtagttgttgtagttatagtcgtagtttcggagtagcgtttcgagtatttagcgcgtgtcggttatggatttcggaggcggcgtagggtttgaaggtagttgttttagtagcgatggtggaacggaagtggaatttagggtcggttgggggtggggtgtgtttggtatatgcgtcgcgggtattgggtggggggttttcgagagtcggaaggaggtggaggagagcgcgacgtttcgtttagttttcgtttttgggcggggttgtttatggtttgggcggggttgtttatggtttgggcggggttgtttatggtttgggcggggttgtttatggtttgggcggggttgtttatggtttgggcggggttgtttatggtttgggcggggttgtttatggtttgggcggggttgtttatggtttgggcggggttgtttatggtttgggcggggttgtttatggtttgggcggggttgtttatggtttgggcggggttcggggaagtgggtgtaatcgaattgttttttttttaggcggtggaaattgaggtttaaagtaagtgaggttaggggtttggcgtagtgatttattcgtagtgatttatttttgtaattttagtattttggtaggtagaggcgggtggattgtttgaggttaggagttcgagattaatttaggtaatacggtgaaatttcgtttttattaaaatataaaaaattaggtcggacgcggtggttttcgtttgtaattttagtattttagtaggtcgaggtagggcggattatttgaggttagtagtttaagattagtttggttaatatggtgaaattgtgtttttattaaaaatataaaaattagtcgggtgtggtgacgggtgttcgtaattttagttatttaggaggttgaggtaggagaatcgtttgaatttaggaggcggaggttgtagtgagttaagatcgtgttatcgtattgtagtttgggcgatagagtgagacgttatttttaaataaataaataaaaaaattaggttagggttattttgttttgggtagggtcgagagttgtagtataagtttgtgttgttttgcgttgtgttatcgaaattcgtggtgtgagtggttaaagaattttttttgaaaggaattgtgatattttggttataaaaaaatcgttgggataatattagagatttggtatttttcgaatttgaggtatgtgaggaaggagaatttcgttgttttaaaatgaaatataggtttggcgtggtggtttatgtttataattttagcgttttgggaggttgaagtgagaggattattggagtttaagagttttagattagtttgggtaatatagggagatttcgtttatataaaaaataaataaagttgggtgtgatggcgtgggtttgtagttttagttatttgggaggtcgattgttttagtttagaaggtagaggttgtggtaagttatgattgttattattgaattttagtttgggtgatagagtgaaattttgtttttaaaaaaataaaagaaaatatatatatttattatgtattgataatatataataaaggtgaatttttttttaatgaaattgtatttataagtgaatatatagagatttgtatatatatatataaagattggttgtgtagtttttttttttttgagttaggatttgttaaagataagtaaaaggaagttgttagagtaaaaaataagagaaagttagtatttttaaaaattttttattgtggaaaatgttaaatagaagagtagaatgaatttttagaattttataaattgttaatattttttagttttgttttatttattttttattattattttttagattttattttttttgttagaatattttaaagtaatgggtattatatttaaagtttgatttgtttaatttggattatttttaggtaaggaaaatttagtattttttagaaaattttttttttaattaaaaaataaagaataagaaaaaaattgataggtttggttttatgaatttggagtattaaagaaaaaggggtttagttttgttttttgggttaaaatatagttcgacggagagtattgttatttttatataaaaatagggataaaagaaaaggtaatagtgtaaatattttattttttaggaagggaggttgggatgttttagtgttaaaatgataaaagaaaattttagagtaagaattatgattttttagaggagttttagaaatgtttaagatagtttggttgggagagggggtgtgggaagggtaggtttttaagagaggtttttatattttttggttagaggttaggtttaggatttattaatgttagtagtttttatttttttttggggtgagagtaggtgttgaggttaggttggtttttgttttttattgtttgttcgtgatttgtttttggatatttggaaaggggttagttgaggttttaggggttgaggtttttttggaaatgtggtttttgggaatgggtttggatatagaagttattggatgttttttttttgaatagtaattttgtttattagtaattttgtaattttttaaggaaaataaagaataggttagttttttttattttagttaaaaaagagaagggggtttttttatttgtaagatttgggaattttagagttatttatttatatagagatagggttttgtttttttgttcgagttggggtgtagtggtgggaatatgatttatattagttttgatttttcgggtttaagtaatttttttgttttagttttttaaagtgtttgggattataagtatgaattattatatttgatttattttttttttcgtaagttttttttttaagaaggaaaatgggttagttttttttaatagattattattataaataataggttgttgatgtattggagattttgtttatatttatttttgtttttatttttttaatagtagtagttattatttataatataaaaatttgaatggattggaaatttaaatagatagaaattttgtattttataattaggagtataaataataagaggtagtttgggtaatttggcgatatttcgtatttattaaaaatataaaaaattagttgggcgtggtgatatttgtttgtagttttaaaaggttatacgtttttttatagtataaattgattttaaaatcggagtttataaggttgaggttttagtgagttgagatcgtattattgtattttagtattttaaagtagtatttgttatttttatgatagagtgagattttgttttaaaagtaaataaataaataaaattaaattataagaggttattggtttggattgagtttttttattatgtttaaaagattaaattaaaatgtagttatttattttttataagattaagttgaaattaagtttatttgattttttgagtaattaggagagatagataatggttaaatttttaaatagattggtgttagttggtaggataaggaaggtttttttgttttgatttttatagggaaaatatttgaaataattaatttgttttgtattttttgtttttattttttttggtttttttttatttataaatttaattttttttgtttagtttattaaaatatttattttatagaatgagatgttgttcgattttagaatagaaaataaaagttaattaagatttataaaagttgaggtcgggcgtagtggtttaagtttgtaattttagtattttgggaagtcgaggtgggcggattatttgaagtcgggagttcgagattagtttgattaatatggagaattttttttttattaaaaatataaaattagttgagtatggtgcgtatgtttgtaattttagttatttaggaggttgaggtaggagaattgtttgaattcgggaggtagaggttgtagtgagtcgagatcgtgttattgtattttagtttgggtaataagagcgaaattttgttttaaaaaataaaaaaaaaaaaatttttaaaaggcgtgtgcggtggtttacgtttataattttaatattttggaaggtcgaggcgggtagattatttgaggttaggagtttaagattagtttggttaatatggtgaaattttatttttattaaaatataaaaattagttgggtatggtggtgtatatttgtaattttagttatttgggaggttgaggtaagagaatcgtttgaatttgggaggtggaggttgtagtgagttgagatcgcgttattgtatgttagtttgggcgacggagagagattttgttttaaaaaaaaaaaaaaaaaagatttgtaaattaaatttattgtaattttgttttttgatagttttggtaattgataaagggatttaaaggatattgttgatgatttttgagattttcggaggaatattagagaggtgttatagagttatagatgttttttgaggttttcggttttttttatggagttttaagggttataggtaagtttcgttcgggtggatttttttttttttttttggtttttgaatttaggattagtttatgttgtgagatagtgtatgattttttgtggtttgtagtggttgataagttattggtaagagttgtagttttgttttggttgggtgcggtggcgtatgtttgtaattttagtattttgagaggtaggtggattgtttgagattagtttggttaatatagtaaaatttcgtttattaaaaatataaaaattagttaagtgtggtggtgcgtttttataattttagttattcgggaggttgaggtataggaattatttgttttaaataaataaagaaagaaataagtagaaaataaaaagaaaaaataaataaaaagaagagataggggtttgatgttatttttcgggttggagtgtagtggttatttataagtataattataggatattattgttttaaattattgggtttaagcgatttttttgtttttgttttgagtgtttgggattataggattataggtttgtgttattaagtttggtttaagagttgtagtttttttttttttttggggggggggggtttgtttgttttttagttgtttatttt

SEQ ID NO: 63 - DNA, 6298 bp, Artificial Sequence
  chemically treated genomic DNA (Homo sapiens)
ggttgtatttagtttattgatgagtttattaaaggtatttttttatttgttttattgttttttatttttagtattttttttttatttttttttagagtttttatatttttgcgtatattatttatgtgtttttgtatgttgtttattgtttttttagaatttttggtatattaattatatttatttaaaatttttggttttaaatttaaaaatttttgttatatgtgagtttgattttgatgtttggtttgtttttttagattgtgttttttgttttttagtatattttgtaatttttttattattgttgttattgttgaaagttagatatgttgtattagttaaaaagaatttaggtagatgcgtttttaagtgtgaggttttatgtttatttggtaaagaggtaggttttgttattgttcgtggtgttagaggttaaaattttttattgtgtttttgtttttgttttttatgttgtttttggttgtttttagagatttttaaaatagggtttgaggtttgagtttttttagttgtaatgtttcgttattatataggagtttttttgatgtggtgataaggtgagggggagaggaggattttttgtagttttatgattagggtttaagttttttagtgagtttgagttgagtatttttttttttttttgtggaaggttagagttgattagagttggtaatttttttttttttagattggttagtttttggtagatttatttggttaggttttgatagagagttttttttgaggttaggttttgttaagaagaatagagagttttgagagtattttacgatggttatttattttttttttttggtaaaagtaaagtagattttttttagatttttatagtgagaatttgataggatttatagaggtaaaattgaggtaagtattgaggttttttttagattgagtttttttggagttttttaatttttaagttagtttgtattgagtttttagtaattttttaattatagtttagtgtttttattgatgttggttttagttgtgaaattagttttagtttttggtttttgtgtttgggttttgtttttggtaaattgtgattttttgaaaagttgtgattttttgtatttatttgtttgtttttttagtttttagggtagtggttttttttgtgattttaattttttggtggatttaagaagagttattgattttagtttgtttagttttttttttttttgttgtgaggatgggagtgataatttttaagttttttatatgttgaataggaaattgaaagttttttggtgtttttttgtaaatttattttaaaaatatttattataattgaaaagtgttaatattaaatttttagtttgtttatattttttttaaatttagataaatatatattttattttgtgtgtttgtgtgtgtgggttttgttgttgtttgttttttgtgtttttttttaagatatagggttttgttttgttaaggttggagtgtagtggtataatcgtatatttttgtagtttcgaatttttgggagaaagtgattttttcgttttagtttttagagtagttacgattataggtattaattattaagtttagttaatttttaaaattttttgtagagatgggagttttattttgttgtttaggttggttttaaatttttggttttaagtgatttttttgttttagttttttaaaatgttggaattatagatattttgtgttttgatttttgaaaggaaaaaataaagatttttaatgttttttattttgtacgtattttttttttaaataatatttttttgttgttattgttttcgttatgaatagtttaaagaaaaagaaataattaagggtagtaataggttaggaattatttattgaatattaggtttttttgtatagtttgatattttataaattgtgtgtatttgatgtattttatttttaaaaggtttaatgttttgtattatttagtagtaattaaaattttaagttttatttaattttttgatttattgtttaattttttaataaatacgggttaagggttaatggggttatttgtaagtaattttgtagtttatttagaaagttttgtaaagttagaaagtgattaaatgattgtttgttaagatatatttatatagtaataatttaaatgtatttgttaagtggttgtagagagagggatttaaaattttattttatatgaaatttttttttttggtgtttgttatttaataggattgtttgaattaggggatattatttggtgtttttgtaattatatgaaaattagttggttgaatattattgttttttatgtttatatttatatttgtatagatatatatatatatatatatatattatttttttttttatttttatatttatatttgtgtatatatatatatataaatatatattttatatatttttgaaaaggaaaattaatttaagggtatatttaatgaatatttaaaaatttttttgttgattaaattattattttgttttaaatttttgaaatgatttaaaaaaattttaaatgatttagatttattgttataaaatgtttgttttttgatgttataaatattatatattataattattggttagagataattgttataagtataatgaaaagggaaatgatggaagatttttgtagttatttttataaatgagggtgggaatacgatgggtagttttaaagttgaaaatagagaatatatgtggatttatattaatataattggtatttttggatagttaaaaatggttaaattgtaggagaagttcgagtaattattgttaatagaggaataaatttgagggtaataataatgatgataggttaggtattgtggtttatgtttgtaattttagtattttgggaattcgaggcgagcggattatttgaggttaggagttcgagagtagtttggttaatatggtgaaatttcgtttttattaaaaatagaaaaattattcgagtgtggtggtgcgtgtttgtaattttagttatttgggaggttgaggtaggagaattatttgtatttgggaggcggagttgtagtgagtcgaaatcgcgttattgcgttttagtttgtgggttagagcgagatttcgttttagaataataataatgataataataataacgttattaataatattaagagttaatatttattgagtgtttattatgtattagatattgttttaagtatatatttattattttatttaattatttataatattgtggtatagatatttttatatttattttataaataagtaaattgagttatggagagattaaacgatttgttagtaagatttaaagtttgtgtataagtttacgtttgattttggagttagtgtttttaatatagtattttgagaatgttaaattaaaaagtttttaatttatagtattttttttataattaaaaaagaaattatgagtaattatttttagtttttttttttttttaggtattttttatggttttttttaagatataatatatattatttagtgttgtagatttgaaaaaataaaagtagcgtgaagattaaaaattttttaaagagacggagtttcgttacgttttttaggttggaatatttaggtttttttagttttatatttttgagtagttggaattattttgttcgttaaggttaatgtttaatcgtatttttgtaggtttattgattagttaaaaagaggtgttgtatatattggttgttgttttgttagagtttgatgtttttatatagattattgtttttatatgttaatataattgaaagttattatagatatttatatttataatttaaagttaggttttaataagaaatttataaggtaaaggtgagaagtaaaataatttagcgttaagtggagatatatgtgtaatgttattttgttgggtttaaaatatattttttttttagaagattgataggtttgaagtttatgtttttaaagataaaagtgattatgttttgtttagtagtttgtaaagttgttaaaggttattttttttattttttttttgaaattggtttatatgtttattaaagttatttatatttatttgtaaatgtttaatatagttttagattttaagatttttttgtaattttattttttttgaagtttatagtaataggagtttatttttatttttaattgtatttatttagtaagtaaatttcgttatagaaaaatttagtagataaggtgagtttttttgtgtttcgtggtaaagagtgcggtgggtgatattgatttatggttaggtaatttggtaaggaaagatttcgttgtaatatatttgagtaacgagattaaaggaagggtttgttgttacgaggcgaagtttgtttttttgaatagagagtttagtagagttgggcggtaatcgtgtttagtattgaggtcgaggagaaagagagtaggagtattatattattgtattaagagtaggaaaatatgatgtatgtttgggattaggtaatcgaaatttttttttagtagcgttttttaaagtcgggtatcgttttttttcggagaaggcgtagagtttttagattcgggttgagtcgtatttttattttttttttttttttttcgtcgttaaatatagacgagtacgtgagcgtcgtagttcgttttagttgtgttttagttgatcgttttttgattggttgagagcggcgtgggttggggtggggatttgtcgtttgcgtcgttcgttattggatttcgaggaattcgtttttattttaggtgaggcgggtttgcgggagcgcgcgtcggtttgggtaggcgagcgggcgcgttttcgttttttttttttttttcgcgcgttcgagcgcgttttcgtttttgttcgttttttgacgttgttttagttttttagtgtatagtgttgtttcgtttgaggggataggaggattatttttttcgtcgtttcggttagtgtgtcgggttgggttttgataagttatttgaggagaggttcggagtcgggttcggatttcggcgattgtcgttcgtttttttttagttttacgaggggtttttcgtttcgtatttttatttttggatttgtttttttttttttttttcgcgtgtggagggagttagcgtttaggtcggagcgagtttgggggtcgttcgtcgtgaagatatcgcggggatcgatttattatggagggcgtcggcggcgcgaacgataagaaaaagtaagtttattttttcggttcgtcgttttttttttcggcgatttcgttcgtttgttcgttttgggtttttgggtcggtttcggcgttaatgggattggggggggtagtttttttgtttttgttgttgttttttttttttttttttttttaatttcgtcggtcgggttttttcgttgtttacgtcgttattttgtcgtggggggtgggagacgtttcgaaagtgtttttaggggtcggggtttgagttttgtttgtttttttcgtcggtcgtgggggtttcgcgtcgtttatttattcgttttaaaaatttagtttgttttgtggttttattcggaggggattttatttagtttgaaaatttcgggaagagaaatgagttgtagttcggtagtcgcggtttgtattcggagttttcgttttttttcgtttttattttttttagttttattgaaaattcggttttggggcggattttgtacgttggttttggttttttagtggatttggggttttgagttttcgattgagggattcgcgtggtcggatgcgattttgttttgtagttgtttagtcgtcgcgggtgtttttgtttttgtgtattagggatttgtcgcgatggttttaagatgcgaattttttagtttgtacgtgtaggttttgtttcgttttaatcgttttgaaaaatttgtttagattgagagttagagtaatgggaatttagggaaatggtaatattttaaagagaattttagaattggatatttgagtttatattatttgttacgagaacgtagatattataaatgaatatatgttttatttattttttaaataatgaaaatgtaggggttggttaaatttaggtagttttaatgatattgaaaaaagtatatgatgagtgaatgaaatgcggtattaaaatgttgtaaaaattttcgaattttgttttatttttttgaaattgaagtatattaaaggaaaatcgttaatatatatttaa

SEQ ID NO: 64 - DNA, 6298 bp, Artificial Sequence
  chemically treated genomic DNA (Homo sapiens)
ttagatatatgttgacggtttttttttaatatattttaattttaggaaaatgagatagagttcgaaaatttttgtaatattttagtgtcgtattttatttatttattatatattttttttagtattattaaaattgtttaaatttaattagtttttatatttttattatttgaagaatgaatgaggtatatatttatttataatatttgcgttttcgtgataggtgatatgaatttaagtatttaattttgaagttttttttaaaatgttgttatttttttaaatttttattattttgatttttagtttaggtaagttttttaaggcgattaaaacgaaataaaatttgtacgtgtaaattaaaaagttcgtattttaaggttatcgcggtaaatttttaatgtataaaggtaaagatattcgcgacggttggataattataggataagatcgtattcgattacgcgagttttttagtcgggaatttaaggttttaagtttattggaaagttaggattagcgtgtagggttcgttttagggtcgagtttttaatggaattggagaggatgggggcgggaaggagcggaagtttcgggtgtaaatcgcggttatcgagttgtagtttattttttttttcggggtttttaggttgggtaaagtttttttcggatggggttatagagtaggttgggtttttgaggcgggtaggtgggcggcgcgaggtttttacggtcggcggggagggtaagtagggtttagatttcggtttttgaaagtattttcgaggcgttttttattttttacgataagatggcgacgtggatagcgggggagttcggtcggcgaggttgggggaagagaggggaggggagtagtagtagaaataaaaaggttgttttttttaattttattaacgtcgaggtcggtttaggagtttagggcgggtaggcgggcggggtcgtcgggggagaaggcggcgggtcgagggaatgggtttatttttttttgtcgttcgcgtcgtcggcgttttttatggtgaatcggttttcgcgatgtttttacggcgggcggtttttaggttcgtttcggtttaagcgttggttttttttatacgcggagaagagaaggaaaggtaagtttagaggtgggggtgcgaggcgggaaatttttcgtgagattagagagaagcgggcggtaatcgtcggggttcgggttcggtttcgagtttttttttaggtggtttgttagggtttagttcgatatattggtcgaagcgacgaagagggtgatttttttgtttttttagacgaggtagtattgtgtattgaggagttgaggtagcgttagggggcgggtaagggcggaggcgcgttcgggcgcgcggggaggggagagggggcgggagcgcgttcgttcgtttgtttaggtcggcgcgcgttttcgtaagttcgttttatttgaggtggaggcgggtttttcgagatttaatggcgagcgacgtaggcggtaagtttttattttagtttacgtcgtttttagttaattaggaggcggttagttgaggtatagttgggacgggttgcgacgtttacgtgttcgtttgtgtttagcggcggaggaaagagaaaggagatgggggtgcggtttagttcgagtttggggattttgcgtttttttcgaaggaaggcggtgttcggttttgggaggcgttgttgagaagggatttcggttgtttggttttaaatatgtattatatttttttatttttggtgtagtaatgtaatgtttttgtttttttttttttcggttttagtgttgggtacgattgtcgtttaattttgttgggttttttgtttaaaaaagtagatttcgtttcgtggtagtaagttttttttttggtttcgttgtttagatgtgttataacggggtttttttttattagattatttaattatgggttaatgttatttatcgtattttttgttacggagtataggggaatttattttgtttattaagtttttttgtggcggagtttatttattgaataaatgtaattaaaaataaaaatgaatttttgttgttgtaaattttaagggaaataaagttgtagggaaattttaaaatttgaaattatgttaagtatttgtaaataggtataaatgattttaataagtatataaattaattttagggaaagagtagaaaaaatggtttttggtaattttgtaagttattaaataaaatataattatttttgtttttggaggtataaattttaagtttgttagttttttaaaagaaaaatatgttttgagtttaataaagtagtattgtatatatatttttatttggcgttaaattattttattttttatttttgttttatgagttttttgttaaaatttagttttgggttgtaaatataaatatttgtagtggtttttaattgtattagtatgtaaaaataatggtttatatagaagtattaaattttgataagataataattaatgtatatagtatttttttttaattggttagtagatttataaagatacgattaaatattgattttagcggatagggtggttttagttatttagaggtgtgaggttggagaagtttgggtgttttagtttagggaacgtagcgagatttcgtttttttagaaaatttttgatttttacgttatttttgtttttttagatttataatattaaatgatatgtattatgttttgaaaagaattatgggaaatgtttgaagagaagaaagaattaaaaataattatttataattttttttttaattgtggaaagaatattgtaaattaaaaattttttagtttaatatttttaagatattgtgttaagaatattggttttagaattaagcgtgagtttgtatataggttttgaattttattggtaagtcgtttaatttttttataatttagtttatttatttataaaatggatataaaagtgtttatattatagtattatggatggttaaatgagataataaatgtatatttagaataatatttggtgtatagtaagtatttagtaaatgttagtttttagtattgttggtggcgttattattattattattattattattttgaggcggagtttcgttttggtttataggttggagcgtagtggcgcgatttcggtttattgtaatttcgttttttaggtataagtgatttttttgttttagttttttaagtagttgggattataggtacgtattattatattcggataatttttttatttttagtagagacgaggttttattatgttggttaggttgttttcgaatttttgattttaggtggttcgttcgtttcgggtttttaaagtgttgggattataggtatgagttatagtgtttggtttattattattattattgtttttaaatttatttttttgttaatagtaattattcgggttttttttatagtttagttatttttaattatttaagaatattaattatgttaatataaatttatatatattttttatttttaattttggaattgtttatcgtgtttttatttttatttatgaggatagttgtagagattttttattatttttttttttattatatttatagtaattatttttggttagtgattatagtatataatgtttgtgatattaaaagataagtattttgtaatagtaaatttaagttatttaaaatttttttggattattttaaaagtttaaagtagaatgataatttgattagtaaaaaaatttttgaatatttattaaatatgtttttaagttaatttttttttttaaaaatgtataaaatatatgtttatgtatatgtgtatatataaatataaatatgaaaatggaaaggaaagtagtatatgtgtatatatatatatgtttatataaatataaatatgaatatggaaagtagtaatatttaattaattaatttttatatagttataaaggtattaaatagtattttttaatttaaataattttattaaataatagatattaaaaaggaaaattttatataggataaaattttaaatttttttttttataattatttaataaatgtatttaggttattattatgtaagtatattttaataaatagttatttaattattttttaattttgtagaattttttgagtagattataagattatttgtaaatgattttattgatttttagttcgtatttattaggaaattgggtagtgaattaggaggttaagtaaaatttgaaattttgattattattaaataatatagagtattgagttttttgaaggtgaaatgtattagatgtatataatttatagggtattaaattatataagaagatttagtatttagtaagtgatttttggtttattattatttttagttgtttttttttttttaagttatttataacgagaataatggtagtaaaagggtattgtttggaaggaaagtgcgtataagataagaggtattaaaaatttttgttttttttttttaagaattaagatataaagtatttgtgattttaatattttgggaggttgaggtaggaggattatttgaggttaagagtttgagattagtttgggtaataaagtgaaatttttatttttataaaaaattttaaaaattagttgggtttggtggttagtgtttgtagtcgtagttattttgaaggttaaagcgggaggattatttttttttaggagttcgaggttgtagagatgtacgattgtgttattgtattttagttttgatagagtaagattttatattttaaaaaaaaatataaaaaataaataataataaaatttatatatatagatatataaaataaaatgtatatttatttgagtttagggggaatataaatagattgaaaatttgatattagtattttttaattatgataaatatttttaagatgaatttataaaggaatattaaggggtttttagttttttgtttaatatgtaaagagtttggaagttgttatttttatttttataataagaaaaaaaaaagttaagtaaattgaaattagtaattttttttagatttattagagaattgaggttataggaaaaattattgttttaaaaattagagagatagatagatagatatagagaattatagttttttagagaattatagtttattaggagtagagtttaggtatagaagttagaagttgaagttagttttatagttggagttaatattagtaggaatattaaattgtaattggggaattgttggaggtttagtgtagattagtttgagagttaaaaaattttaaggaggtttagtttgagaggggttttaatatttattttagttttatttttgtgaattttgttagatttttattgtaaagatttgagaaaaatttgttttgtttttgttagggagaaggggtaagtaattatcgtgaaatatttttagggttttttgttttttttaataagatttggttttaagggaaattttttattagagtttaattagatgaatttattaaaggttaattaatttggaggaagggaaattattaattttggttagttttagttttttataggggagaagggaaatatttaatttaagtttattaaaagatttgagttttaattataggattgtagaaagttttttttttttttttattttattattatattagaagagtttttgtgtaataacggggtattatagttaaaagaatttaaattttagattttattttaagagtttttggggatagttaaagataatataggaagtaaaaataaggatatagtaggaaattttagtttttgatattacgaatagtaataaagtttatttttttgttagataaatatgaaattttatatttaaaggcgtatttatttaagttttttttaattgatatagtatgtttggtttttaataatgataataatgatagaaaaattataaaatatgttaaaagatagaaaatatagtttgaagagataaattaaatattagaattagatttatatatggtagagatttttgaatttgagattaaaaattttaaataaatatgattaatatgttaaggattttaaggaaatagtggataatatgtaagaatatatgggtaatgtacgtagagatatggaagttttaagaaagaatagaaaggaaatgttagaaataaaaaataatagaataaatgaaaaaatgtttttaatgggtttattaatagattggatatagtt

SEQ ID NO: 65 - DNA, 7380 bp, Artificial Sequence
  chemically treated genomic DNA (Homo sapiens)
  unsure (12, 91, 103, 190, 212, 271, 279, 677, 694, 718, 724, 729)
  unsure (861, 864, 954, 1249, 1464, 1757, 1849, 1894, 1914, 2038, 2117)
  unsure (2130, 2471, 2698, 2831, 2956, 3023, 3308, 3354, 3415, 3423)
  unsure (3566, 3600, 3605, 3640, 3654, 3760, 3929, 3937, 4110, 4480)
  unsure (4530, 4552, 4587, 5252, 5296, 5303, 5367, 5382, 5483, 5536)
  unsure (5558, 5567, 5654, 5661, 5668, 5825, 5851, 5932, 6184, 6225)
  unsure (6227, 6513, 7312)
atttaatgtggnataattttgtagaggttttgttaataaattgaatgagttattgaaagtgaggtatttattttagtcgtaaattttggtngaattttttttntgttgttggatatgaattagattttaggaaatttagaaagaatatagaaatagtattattttgtttttagtgataaaatatttattnttttttcgggattaaaagtttngggttatttataaatatatagttaaataattgttagtaataatattaaaagaatttaangggggggntcgggcgcggtggtttacgtttgtaattttagtattttgggaagttaaggtttacggattatttgaggtcgggagttcgagattagtttggttaatatggagaatttcgtcgttattaaaaatattaatattaaatattaatattttatcgttattaaaaatattaataaaaattgtcggatgtggcggttggtgtttgtaattttagttatttaggaggttgaggtaggagaattgtttgaatttaggaggcggaggttgcggtgagttgagattacgttattgtattttagtttgggtaataagagcgagattttattttaaaataaaataaaataaataataataataaataatttaagggggaaatgaaagtttaaaataattggatatttttnatgagtaaaattaattnttaatttttattttatagtatatnataaanaattnaatttgaaatgggttataaggttaaatgaaaaagtttaaattatgaaagttataaaggaaagtataggagaatatttttagaatttaggagtagttaaaagttttttagtttatagtaagtaataattatgnaanaaataaattgataaattgaattttgttaaaattaaaaattgtttatggaaagacgttattataaaaattaattagtaagttatagattgngaagaaaatatttataatatataaatatttgataaagagattatttaaagtatataaaagaatttttaaaatttagtaattaaaagataattaaatttaaaaatgggtaagagatttgaataggaagatgtataagttattaagaagtatatgaagtagtatatgttattattttttattaggaaaatttagatgaaaggtttattgagaattgattatttatttattagaatggttataagttttaagagaaattgatattattaaatattggtgaggcgttagaataattagnaatttttatatattgttgttggaaatgtaggataatttatttgttttagaagattatagaagagttttttttaaagtaaaatatatattttttttatgatttagtaattttatttttatttgtttatttaagagaaaggaaagtatgtgtttataaaagaatttagataagaatttttataaatattttatttatgtttaaaaattggaaataantttaaatgtttattaatataatagataaatttttgtatatttatagagcggaatattatttattaatataaagaaatgaattatatgtaatattggtgaatgtttaaaatattgtgtagagtgaaagaagttatatataagagagtatatatagtatgattttatttgtatgaaattataaaataagtaaaatgaatttatggtgtaaggaggttatgtaaagagaaagagaaggttagttagtttagtattttagttgagtttaatttagattgtagaataatgagaaatanataaaatgattgttgttttaagttattaggttttggagtgatttgttatatagtaattaataattagtattattgttttttttatggaattngttagaagtatgtgatatgatatatatggaagggttttgtaagtnggataagtgttaagtatttngtgagcggtagttatttttgggtatatgtgtagattggggttagtgtttattagggatatgtttatttgagaattaatttgtggaatttagagggttttattatttaattaatataatttttgngttttttttatttttttttttttttttgagtagttatttataattgtttttggggaagagagagagagaaagagaaagnaaagatgtttatnggtttgttaaaaaaataaaagaaaataatatttataaatggttagagtagaaaagatgtattaattttatttattttgttaaggaatggggttagattgaagattagttaatgtttataatttttgaggttttaagaaatatttttgaagttagagaaggatggagagaagtgagagggagttattatggtttaaggggttggtttttaatttggttcgtgatatgttgattaggtttagggaaattaaattaaatgaattaaatttttaagaaattgtttgattaattagaacgttagtttatttatttgtaatgagaaatgtaatttttaagttatagntatttggttttgttaggtggtaaggagaagattattttgggaaattagattatttgatttggtaagagttttatgtttggaaatatggggaagtgaggatatgcggagaattatgagtaggtggagtattttgggcgtgttgagtaatgttagtggattgttatataaagtttaggtaacgtattttttatgtatttggaatttgtaatttaatagatttttaattnaggttgagaggatgtttttagttttgttagtttatggatttatagggatgtaaggaatttaagatagggaaatagtttttgtttttaaaaggatagcggagatgaggttttttttttattttttaaaaaaatnaatataatataattgatggatttagatcgtttacgagagattattatttttacgtttagtttaggtattttttttagaattttttttttaataatgtaagtgtttttgttatttttatttatttnatttttgtttttttaagtttattttatattatttgtttatatgttaaattttaaacgatgagttttntgaaggttaaaattatgttttatttatttttttttattagttttcgtatagtcgttggtatatatatcgtggtgtttaataaatgtatgtggtattaattaaaagtttgttgtttttggaattcgtttgaaatttgaaatattgtaataatattttatttagaatgttgttttatttttttgttataattttagagtgaggaagtagaggttattagattacgtgtttttttatgaagaatttatagtttagggtagaaaggtatttgtcggaattattttgttnagggaattttgaatttcgttgcgtcgtcgtttttgatttttggggnttttaggcgtttttttttttataatttttttttggggaagtaaattttattaagatattanttatattntttttttagcgatttagtttggggttataaaggtttttacgttttattgaaaaacggtttttttttatttgtgtttattcgtttttgtagttttttttttagatcgaagattagggttttagtaaggagaggtaaggaggganggggaagaatttgtttggtttttcgcggagtttntgtangggggcgtcgcggttgtacgttagcgttcgtattnattttaggcggganagggagttattatatagggggtcgtacgtagatttcggggatcgtgggtgttacgaggttaaattggtagagggagacgttgtagttgttgtaatagtaaggaaangtcgaagtttttttaggggatattttataaaattattttaattatcgtgtaaatttaataatttgatttaagcgtaattatttgtatttatttagagtaaatatttttaaaatttcgtttagtgtgtttgtgtttttttcgttttttttcgttttaggtaaatgtttantttttttntttttttttatcgttaatatttttttgtagcgtgggaaatagtgtttagtagtttagtttttcgtttttcgttttgttttttgtattttattcggatttataggaagtagttattttttggtggtggtggaaattgggtaagaaagaagacgttaagtttggtcggggttagngagaaatattgagaagggtcgttattttttattcgatttaaattaattattttaaatttggttattttttggaattatttggggagttttaaaaattatggacgttttgatagtatcgtagaggttttgatttaattgatttgggatgcggtttgggtatcgcgatttttttaaaattttttaggttatttttagtttgaaaattatggatataaattttttatttttttttttatttagattaaaaaaaaaaaaaaaaatttaagtttaagttgatggtttagggaatttggtatttgtttttttgtaattagttagtgttgtaaggttttcgaaaatcggcgcgagcggcgacgttaaatacgcggtnggcggggcgagcgggttaggcgggcggtgtcgcgcgtggtttcgtttttngtacgtttatgggcgcgaggtngcgggttttgacgttatttttgttagggtcgcggntatatgggcggtcggatgcgttgagttcggcgttgcggggtcgcggagcgttggggagtagcggtcgtcggcgcggggaggggggtggggtgggacggcgtatcgttttcggtgttggtattaggggttggggtcggcgcggtgttttttgtttttttgtagtcgtcgatattttttttttttttttttttttaattttgaatattttgtaaaacgaggggttcgaggtaggtgagagtattttgtacgtcgtcggggagttcgcgggtatttggcgcgtttttttgggatcgtttgtattggaaattcgaaagtttttttttaatatatatttttatgtagatgtatttataaagatataagtaatttttttttttttttttttttatcgttttgagagcgagtatttttggtaaaggacggaggaaaagtttagtaatattttagggggcggttgttttttttttatttttttttttaaggggaaaaaatttgagtgtatcgcgatggagaaaatgtttcgatcgttttttttgaattttatttttatttcgtttttttacggcgtgtttaggtttttgttggagaattcgttgaagttttttttttattacgaagacggtgagcgttgtcgcggtttcgtttcgggaagggacgacgttttngggggttttttttcgcggtcgggtacgttcgttggagtattttnttaattntcgttttcgttttgtttcgcggcgtttcggtttcgcgttgatgaaattgaggagtttatttagntattttttttttttntttttttttttttatgaaaggggagggattttttttgagttatatttaaaagagtttcgggtattcggtttttttgggtttcgtttttgcggcgcgggtgnggaggtgtaatttgataggttaggatcgttttttagaacgaggtatattcgtnacgtagagcgagttcgtttgtnggagggtangagtttttcgggttggggaggagaaattttggggtttggttttgtgcggggtagggggcgggggtcggtttgagggagggggttttnattgcgntagtttngggttttggggttgtgttatagtttttgttattggttagtatttggaatttacgaggtgtgagagaagattcgtttttttttggtgaagggtagttgagaaagcggggtgggggttggggtcggtggggggagtggtttttcggcgggaagtcgtgntacgtttttagcgttgatattttttncggtgtattttttttggtgggaggggagagcggagtaggtttacgtgtaatcgcgtaggagttttttttggtttgagtttnttttttggtaagttttaaatttttttaagataattttggttttagtagtagaggaggggtacgtgtgatgaggttttaaattcggttaagtgatgttacggatttgggttgatgcgattttatgttttcggtattatagtagtaaatgcgaatcgtgcggtttatagtgtaaagttttgaaaggttatttggttataaatagtttgggagtatttgtatttttttttttaggagaggataatttgttgtatntgtaagagtttgtaatttgtagatgatagttagggattttntnttttaattattttttaaggaagagtatttgggaggaaggggttgtttgtaggtttttgtatttgtgggtgttttaagttagatttttagatgagatggtagagggttagaatggatggtagtggaggttgtgtttttttgaagatgaaatttagaagtaaattttttaattttagattttatttacgattgaatattagaattggtaagattcggaatgtttgttaaagatttaatgggcgagtagtatttttaggtagtaaatagttgtatatttttaatataanatgtatagaataatttattttttttaatagttttgtttttgaaaggttttgtaaatgtatattttttgtaaattggattatatttaaatgtttggagaagagaaggaagaaaatattttgtatttttttaaattttttttgtaaaaattagtgtgttttagtggttttagaagtaaatatatgtgagtttagaaagtttttattttttgttaatatgaggtattggttaagtttttttaagttttagagttttcgagtttttgttgtaaatggaggtaattgttattttgtaagtttattgtgagatttttgagataatatatggaaagaattaggtatttagtaggtattttaaatatgatgttaaagaagggtggaaggtttttgttttattaaaattaagattattaatttattggttttgtaagtttgaatgattttttattgttgttgtgatgaatttttggaagataatttaagtttggttattggttgttgtttttttaaaaatgatagtagttgtatataattatagatgttatatttttattttaggtttaagttattattttttttaaataatgtgttgagattgttttttggtttttattttagattagtttgtagttttgttttaaggattagtgttttttttttaaagtaaataggaagatgttgaaaaataggtagagatttacgttttgtttgaatttttaattttagatttataaaagatagtagttagagaaggattttgttattcgtgagaaatagttttataataggttaggaaaagtgnataaaagagcggtattgttttttttttttttttttttttttaagtttagttttttttttttttgtagt

SEQ ID NO: 66 - DNA, 7380 bp, Artificial Sequence
  chemically treated genomic DNA (Homo sapiens)
  unsure (69, 868, 1154, 1156, 1197, 1449, 1530, 1556, 1713, 1720, 1727)
  unsure (1814, 1823, 1845, 1898, 1999, 2014, 2078, 2085, 2129, 2794)
  unsure (2829, 2851, 2901, 3271, 3444, 3452, 3621, 3727, 3741, 3776)
  unsure (3781, 3815, 3958, 3966, 4027, 4073, 4358, 4425, 4550, 4683)
  unsure (4910, 5251, 5264, 5343, 5467, 5487, 5532, 5624, 5917, 6132)
  unsure (6427, 6517, 6520, 6652, 6657, 6663, 6687, 6704, 7102, 7110)
  unsure (7169, 7191, 7278, 7290, 7369)
gttgtagaagaagggaaagttggatttaaaaaaaaagaaagaaaagaaaaataatatcgtttttttatntattttttttggtttgttataagattattttttacgaatggtagggtttttttttggttgttgttttttgtagatttagagttaaaagtttaggtaggacgtggatttttgtttgttttttaatatttttttatttattttggaaagaaggtattagtttttggggtagggttataggttgatttaggataaaaattagagaatagttttagtatattatttgagaagagtaataatttaaatttaaaataggaatataatatttgtgattatatataattgttgttatttttaagaaaataatagttaataattaggtttgaattattttttaggaatttattatagtagtaataggaggttatttagatttataaagttagtgagttagtggttttaattttggtaaagtagggattttttatttttttttaatattatgtttagagtatttattggatatttggttttttttatatattattttaaaaattttataataaatttgtaaaataataattatttttatttataataaagattcggaggttttgagatttgagggaatttgattaatgttttatgttggtagagaatgagaattttttgagtttatatgtgtttgtttttaaagttattggggtatattgatttttataaaaggagtttaaaaaaatataaagtgttttttttttttttttttttaaatatttgagtatgatttaatttataaagagtatgtatttataaaattttttaaaagtagagttattggaaaaggtgagttattttatatatnttatgttggaagtatgtagttatttgttatttggaagtattgttcgtttattaggtttttaataagtatttcggattttgttaattttagtatttagtcgtgggtggaatttgggattaaggaatttgtttttgagttttatttttagagaaatatagtttttattgttatttattttaattttttattattttatttgaaaatttgatttaaaatatttatagatgtaaaagtttgtaggtagttttttttttttaaatgtttttttttaaaggatagttagggnanggggtttttggttattatttgtagattgtaaatttttgtanatgtaataggttgtttttttttagaaaagaaggtgtaagtatttttaagttatttgtagttaaataattttttagaattttatattgtgagtcgtacggttcgtatttgttattgtgatatcgaaggtatgaaatcgtattaatttaaattcgtggtattatttagtcgggtttggggttttattatacgtattttttttttattgttaaggttaaggttgttttgggaaggtttgggatttattaagaaangggtttaagttagaggaggtttttgcgcggttatacgtgagtttgtttcgttttttttttttattagaaaaagtgtatcgnggaaagtgttaacgttggaggcgtgntacggtttttcgtcgagagattattttttttatcggttttagtttttatttcgtttttttagttattttttattagaagaaaacgagtttttttttatatttcgtgagttttaaatattaattagtaatagaagttgtaatataattttaaaatttnaggttancgtagtngaaatttttttttttaagtcgattttcgttttttgtttcgtatagaattaggttttagggttttttttttttagttcgggaggtttntgttttttngtaggcgggttcgttttgcgtngcgggtgtgtttcgttttagggaacgattttgatttgttaagttatatttttntattcgcgtcgtaggagcgggatttagggaggtcgggtgttcgaagtttttttaaatgtagtttaggaggggtttttttttttttatggaggaggaggaanggggaggaagggtgnttgggtgagttttttaattttattagcgcggggtcggggcgtcgcgggatagggcgggagcggnggttggngggatgttttagcgggcgtgttcggtcgcggagggggatttttnggagcgtcgttttttttcggagcggggtcgcggtagcgtttatcgttttcgtggtgaagggggagttttagcgggttttttagtagggatttgagtacgtcgtagggaggcgggataaaggtgggatttagggggagcggtcgggatattttttttatcgcgatgtatttaaattttttttttttaaaaaaagaaataagaaagaaataatcgttttttaaaatgttgttgagtttttttttcgttttttgttaaaagtattcgtttttaaggcggtggagaaaagggaagaaaaaaattatttatatttttataaatatatttgtataaaaatatatattaaaaaaaaattttcgggtttttagtgtagacggttttaggagagcgcgttaagtgttcgcgggtttttcggcgacgtgtaggatgtttttatttgtttcgaatttttcgttttgtaaaatgtttaaaattgaaaaaaagaaagaaaaaaaaatgtcgacggttgtagaagggtagaagatatcgcgtcgattttagtttttagtgttagtatcggaggcggtgcgtcgttttattttattttttttttcgcgtcggcggtcgttgttttttagcgtttcgcggtttcgtagcgtcgggtttagcgtattcggtcgtttatgtgntcgcggttttgataagagtgacgttagggttcgtnatttcgcgtttataggcgtgtngggggcggggttacgcgcggtatcgttcgtttggttcgttcgtttcgttngtcgcgtgtttagcgtcgtcgttcgcgtcgattttcggggattttgtagtattggttggttgtaggggagtaggtgttagattttttgggttattaatttaggtttagatttttttttttttttttggtttgggtgggaagaggaatgagaaatttatatttatagtttttaagttgggaataatttgaggagttttaaaaaaatcgcgatatttaggtcgtattttagattaattagattagaatttttgcggtgttattagggcgtttataatttttaaagttttttaggtggttttaaagagtagttaagtttgagatgattggtttagatcggatggaaggtaacgattttttttaatattttttnttggtttcggttaagtttagcgtttttttttttgtttagtttttattattattaaaaaataattattttttataagttcgaatgggatgtaaaaagtagagcgggaagcggaggattgagttgttgggtattgttttttacgttgtagagaggtgttaacggtggggggagangggggggntagatatttgtttgaaacggaaagaggcgggagagatatagatatattgaacgggattttaggaatatttattttgggtgaatataggtgattgcgtttgggttaagttattaggtttgtacggtgattaaaataattttgtaaagtattttttaagggggtttcggtntttttttgttgttatagtagttgtagcgtttttttttgttagtttgatttcgtggtatttacggttttcgagatttgcgtgcgattttttgtgtgataattttttntttcgtttggggtnggtgcgggcgttggcgtgtagtcgcgacgtttttntgtangagtttcgcggggggttaggtaggtttttttttntttttttttatttttttttattaagattttagttttcgatttggggaaggggttgtaagaacgaatgggtataaatgaaagaaaatcgttttttagtgggacgtaaaggtttttgtgattttaggttgagtcgttggggaagngatgtggntggtgttttgatggggtttatttttttaggagagggttgtaagagaggaggcgtttgaaanttttagagattaggagcggcggcgtagcggggtttagagttttttnggtagggtgatttcggtaagtgtttttttgttttgagttgtaggttttttataaaaggatacgtaatttagtgatttttatttttttattttaaaattatggtaaaagggtaaggtaatattttaagtgagatgttgttgtagtgttttaggttttagacgaattttagaaatagtaaatttttagttaatgttatatgtatttattgagtattacggtatgtatgttagcgattatgcgggggttagtgaaaaaagatgaataaaatataattttaatttttanagaatttatcgtttagggtttggtatataagtaaataatataaaataggtttaaaagaataaaaatnggatagatggaggtgataggggtatttatattattaggaaagggattttagagaaggtgtttgagttgggcgtggaggtaatagtttttcgtgaacggtttgaatttattaattatattatattngtttttttaaaaaataaaaaagggattttattttcgttatttttttggagatagaggttatttttttgttttgagttttttatatttttgtaagtttataaattggtaggattgagagtatttttttagtttnggttagaaatttgttagattgtagattttaggtgtatgaaagatgcgttatttaagttttgtgtaatagtttattgatattatttagtacgtttaaagtgttttatttgtttatgatttttcgtatgtttttatttttttatgtttttagatatgaaatttttattaggttaagtaatttggttttttagggtaattttttttttattatttgatagaattaaatanttgtggtttggaaattgtattttttattgtaagtggataaattggcgttttggttgattaagtagttttttgggaatttggtttatttaatttaatttttttgagtttgattaatatgttacggattagattgaggattagttttttagattatggtgatttttttttatttttttttatttttttttaattttaaaggtattttttagagttttaaaaattataagtattggttaatttttaatttagttttattttttaataagataaatgaaattggtatattttttttattttggttatttgtaaatgttatttttttttatttttttaataaattnatgaatatttttntttttttttttttttttttttttttttagaagtagttgtggatggttgtttaagaggaaggagagggatagaagaaatntaaaggttatattggttgggtagtaagattttttgaattttataggttaatttttaaatggatatatttttaatgagtattaattttaatttgtatatatgtttagagataattgtcgtttatnaagtgtttagtatttgtttnatttatagagtttttttatatgtgttatattatatatttttgatnaattttatgaggaaagtaatgatgttgattattgattgttgtgtaatagattattttaaaatttagtggtttaaaataataattattttatntattttttattattttgtaatttaggttaggtttagttgggatattgggttggttggttttttttttttttttatatggtttttttatattatagatttattttgtttgttttataattttatataagtgaaattatattgtatatatttttttgtgtgtagttttttttattttgtatagtattttagatatttattaatgttgtatatagtttatttttttatattagtgagtagtatttcgttttatgaatatataaaagtttatttgttgtattggtggatatttgggnttgtttttagtttttaggtatgaataaaatgtttatgagaatttttgtttgagtttttttgtgaatatatgttttttttttttttggataaataaataggagtaggattattggattatagaaaagatgtgtgttttattttagaagaagtttttttatagttttttgaagtaggtaaattgttttgtatttttagtagtagtatatgagagttnttggttgttttagcgttttattaatatttagtggtgttagttttttttaaaatttgtagttattttagtgggtggatagttagtttttaatggattttttatttgaatttttttgatgaaaaatgatggtatgtgttattttatgtgttttttagtagtttgtatatttttttgtttaagttttttgtttatttttgaatttggttattttttgattattgaattttaggagtttttttatatattttggatagtttttttgttagatgtttgtgtgttgtgaatattttttttntaatttgtggtttgttgattagtttttataataacgtttttttatgagtagtttttaattttgataaagtttaatttattaatttgtttnttntatgattattgtttgttatgaattaggaaatttttgattatttttgagttttggagatatttttttatatttttttttataatttttatagtttaagtttttttatttagttttatgatttattttaaattnaattntttgtngtatattatgaggtaaggattaanggttggttttatttatnggggatatttaattgttttagatttttattttttttttgaattgtttgttgttgttgtttgttttgttttgttttgagatggagtttcgtttttgttgtttagattggagtgtaatggcgtgattttagtttatcgtaattttcgttttttaggtttaagtaatttttttgttttagttttttgagtagttgggattataggtattagtcgttatattcggtaatttttattagtatttttagtagcgatggggtattagtatttagtattaatatttttagtagcgacggggttttttatgttggttaggttggtttcgaattttcgattttaggtgattcgtggattttggttttttagagtgttgggattataggcgtgagttatcgcgttcggntttttttnttgaatttttttgatgttattgttgataattatttgattgtgtatttgtgggtgatttnaaatttttgatttcgaggaaanaatgggtattttattattaaggatagaataatgttatttttatgttttttttaagttttttgggatttgatttatatttagtaatangaaaaaagtttnattaaagtttacggttaaaatgaatgttttatttttagtggtttatttagtttgttgataagatttttataaagttgtnttatattaagt

SEQ ID NO: 67 - DNA, 7089 bp, Artificial Sequence
  chemically treated genomic DNA (Homo sapiens)
gattttgggagaagaaatagtatatatatttaaaagttttggttttgttgtagttttattgtgtttgtttttaaaaaattcgatgtgaagattttttttaaataaaaatattttttataataggataaagttatattttagtatagtgatatttatgattattttcgttttttttttgtatggtttttgtgttatttttgataggtttattattttagtgtattatattttgtaatttggttttagatagaagatttttttttttttttagaagtttgtttgggttgtatagggttatttcgtttagtagtgtttataattttgtttgttggttttttgttgtttttttttatttatgttacgtatacgagtttataaggattgtttttcgatttttttttttttttttttttttttgagatggagtttttttcgtgttgtttaggttggagtgtaatggcgtaatttttgtttattgtaatttttgttttttggatttaagtaatttttttgttttcgttttttgagtagttgggattataggtatgtattattacgtttggttaatttttgtattttttttagtagagatatgttggttaggttggttttaaatttttaattttaggtgattcgttcgtttcggttttttaaagtgttgggattgtaggtgtgagttatcgcgtttggtcgttttgttgttgtgaaatgttttttttaggcgtattaaatttatttatttatttattgaatttaagttaattgtagttgaaaataaattaacgatgtagttttatggttagagtattgttaaaagttagaattaatttaattttgtttatagttaaatcgttattattgaaagatggtatttgaggatgtaaatatttgaaatttttattttgttattgtatatttttttttaattaaatagtaggtgttaatataataggaagttttttaagaaagtattatgtaagttttagtatttgaatatcgtaatattttggtttatttaatgttgtttagatattgtaagttgaaagaaggtttttattaatatatttatttgtaaaaagatggtgattatttttacgaagtttatgagatcgttcgtataattttttggtattttttcgagattttggatataattttatttttattgtttttattttttgtttagaattagggttaagaaatataataattggatattattgggtatagttaagacgattaattgtatttggtgttatatttaataaagtatgtttgttttagaaatagaaagaaaaatatatataaagatataagatattattaattaagaattattaaatttagttgggtgtagtggtttacgttacgtttataattttagtattttgggaggtcgaggtgggtgaattatttgaggttaggagttttagattagtttggttagtatggagaaattttatttttattaaaaatataaaaattagttaggtatggtggtgtacgtttgtaattttagttatttgggtggttgaggtataagaattatttgaatttgaaaggtagaggttatagtgagtcgagattacgttattgtagttttatttgggtaatatagtaagattttattttaaaaataaaaataaatataaattaaaataaaataaaatattttattatatttagaaaaagttaaaagtttgtattatattttagtggtaatagatttttttgtattttaatgttttaggagtatatattaaaaaattaattgtaagttaatttaattttatttttagttaaatttttaaaaatttttttatgaagtttatttttaagatttagttttaatatcgtaatttgatagtattatttacgtatagttagaataaaaatgtttaagaatttaatgtttttgatattttttatgaatgtaaataataaattataatttgaattgtattgatataatatataagtagtttgttaattatatttaaaaattatatatttgttttgtggtaatgaaaaattattttttgatgtttatagtaattatttttttgaaagtaattattataatgttttttagtaagggtttaatttttttatagtatgttagtaatagttttagaaaaattattttttatttttaaattaattaaattttattttatttaaaattataataatataatgaaatgggttaagttttaataatttatttgatttatgatttgttttattgtatgtaggcgaataatgttagagttacgttggttagttttagcgtttcgtggtttattttttatttattatgttaggataaaaataagatattaaatttttattggttagataggagttttttaattattggttataattgatatgtcggattggatagtattttgtttgtggaaattgttttatgtatgtagtatttaaagtgagttttaatatgtatattttttttttttttttttattatttttttaattattttaatattttggaaaaaaatttagttattaaagaagaaaaaatatataggaatgtatattttttttttttgtttggggttttaatatggtttaatagggtattattttttatttttttttatattgtaatatttagagaaaatattatttgtatggtatattgagataaattgagggggttgtttttttgttaagttttaattagttattattggtttaagaggttaatattttggtatgtttattaattatcggtaatggtgttatagtggattgtttagggagttttgggttagagattttagttatattagtagaaggggaatttgggggtaggaagttgtttatttgtaattgtgagatagtttatggttttattttggtaatttgtttttattggtgtatattgtgttaaatgtagtttgggttggtttttaattaattattttagagtatagtaacgtttgtgattttggttataaggaaagtttgaaaggaaaggaagagttttggtgttttagagattagataaaggtagagatttggaaagataagttatattgaggtttaagataaatgattttggagaatgagattattataagataaagtattatgggtaagtagggtagaattttaaatttagtgaatattggagaattaagaagaaagattaattgggaattttggttggaaaaaaaatgttattaattttttaatttaaaagattgttattagatttaaagaagatataaaattaagttatttgaattttttgttgtggagtaaatttgattaaattaatgtattattttttaaggtagagttttgtaagttattatatttgttttttttatatttaaaaattttaagtttggttatgggtaagggttattattaattttttttaggtgaaatgttatttatagataatttagttaggtgcggtggtaggtgtttgtaattttagttattaggggaggttgagataggagaatcgtttgaatttaggaggcggaggttgtagtgagttgagattgcgttagtgtattttaatttgggtaatatagtaagattttgttttaaataaaagaaaataaaataaaataaaattttttttgaaaaaattaagaaataaatattttttaatttgtttagattttatttaaattatttgtttgtaaattttttgatgtttagaaaataaatatttttatttaattttattggtaatgaaatgaaaagtaatatattaaaaaaaaaagatgatgttttgattttttaaattaatattatgtagtttaaagatgttattgagggtcggttgggtgtagtggtttacgtttgtaattttagtattttgggaggtcgaggtgggtagattacgaggttaggagatcgagattattttggttaatacggtgaaatttcgtttttattaaaaaaataaaaaaattagtcgggcgtggtggcgggtgtttgtagttttagttattcgggaggttgaggtaggagaatggtatgaatttaggaggtgaaatttggagtttggatttgagatcgtgttattgtattttagtttgggcgatagagcgagattttgttttaaaaaaaaaaaaaaaaggttattgagggttatatagtgttagtgggaataaaatttttagtataattttttggaaagtagaaattttattataattatgggaatagttatatttttaaggatttaaattttttgggaaataaagtagggtataaataagtaaataaaatatggatagatttttgtattttttgtaatagtaatataaattcgaaataaacgatataaaaaaagtttaattgaattaaaaattgtaggataaaatgaaaatatgttattatttatgaaaaagaaaaattggatataaatttttttaaatagtataaataaaattttgttaaaatatgtttaaaagagtggaagaaaatataatggaataaaatttagggtggtgatatgtgtaaaaattaattttttaatttttttaaatatagaatggtatttttataattataaaaatagtttaaaaataaaataaaattgggtatagtggtttatatttgtaattttagtattttgggaggttaaggttagagattatttgagtttaggagtttaggtttagtttggataatttagtgagattttgtttttataaaaataataataataataataataataaattagttaggcgtgttggtatgtgtttgtagttttagttgtttggaaggtcgaggtgtgtggattgtttgaatttatgagtttgggattatagtgagtaatgatttaattattgtatttttgtttgggtaagagtgagattttgtttttgaaaaaaaaaaaagaggagtagtgtgaagaagaggcgagaacgattttcggatcgattaaagttcgcgtgtcgttgtattttacgtttagtatttacgttttgtcgttatcgttattatgtttaagagaaaggttgaaggggatgttaagggagataaagttaaggtgaaggacgaattatagagaagattcgcgaggttgtttgttaaatttgtttttttaaagttagagtttaagtttaaaaaggtttttgtaaagaagggagagaaggtatttaaagggaaaaagggaaaagttgatgttggtaaggaggggaataattttgtagaaaatggagatgttaaaatagattaggtatagaaagttgaaggtgttggagatgttaagtgaagtgtgtgtatttttgataattgtgtatttttggtgattgtatagtttgaaatatttttattaagttttataaaaatgtagaattttgttttatttttttttttttttttttaagttatgttgttcgtatatagaatattttattgttgtttttgggggaaggggtatatgttattaatagaatgtttttaaaattggattgatgtggagaaaatattttttttttttagttttgagagatttttttttggtttttaggaggagggattttttgattttgatatatatggttattttggtataaaagttttgtgttatggaaaaataaatttgtttttatgtttttttttttttttttacgttttagtatagatttaatttttttaagtttagatatttgttgagatttgatttttagttattggttattagtgtgttaggtaatttggattttttagtgatgttattgagatggtatttgttaaaagagtagtggttttatttttagattgtggatttttagataaattttgttattttcgttttattttttgaaagttagggttggtttgtgaaaagttgttaaataatatgttaaatgtgaaatgttaatttttatttttaattttttttgtttagagtattagatgaagattttattgggttttatagtggttttttgatttttggtagtttattgaagaagggagtttgaaagttgttgtatattgttaacgattgtttgtttatgttttgtttgaaatattatgattgtttatggaaagtatttttaataaagttggatatagtttggtttggaaaaaaaaaaaagaaagtaaataaaataaggatttgtaagtaaaacgtatttggtatataaagtattgtagttttaatatttatatttattattttattataaatgtttgtaataataatagttgataatattagtaatgttttattattttttttaattatttgtgtatttgttagtttaatgattaaaagagttggaatggagtaagaaagggttgtggttaaagtcgagttttgttatttgtttattgagggttattaggaagtttagattgaagaaattggaaaggatttacgtaatgattatttaagttttaggttatttaattgtaatatggatattatattttttattttagagtatgattgggaggatttaatgatattgtatgttatgtaatttttatatgaagttaagagttttttaaacggtgattttttttattaaaagaattggtggaataaggatatggttattggggtttttttattaaattaaaagaatgggataaattgttaattttttattgataaaaagttttatttttattgaatgagtgaattagaatttatttattttagaggtgtaatttttaattttatttaagttagttttgaggttatttatttgtaatttgataaatatttggttttttttttgttagtttttttttggtaatattagttattggtttaaaaatggttataggttttagaaatttagttggagagaaatttatatgaaaaatagtatattttatatttttttttttttaaatatattgacgttaaagggtattaggttagtttgtagaaaataaattattttttcgaagaattatttttttataagttggaaattttgtttgaataggttgagcggataaattttttttgttttttcgaagattttttttggagttgcgaagatttttgaatttttagaagttagtacggttttcgtttgttgtttttggaagtgtatattgtatattg

SEQ ID NO: 68 - DNA, 7089 bp, Artificial Sequence
  chemically treated genomic DNA (Homo sapiens)
tagtgtatagtatatatttttaaaaatagtaggcggagatcgtgttgatttttggagatttagaggttttcgtagttttaagagaaattttcgaaaaagtagagaggatttgttcgtttagtttgtttaaataaagtttttagtttatgaaagagtggtttttcgagaaggtagtttattttttatagattaatttaatattttttaacgttaatatgtttaagaaagaaaaggtataaaatatgttgttttttatgtgaatttttttttagttggatttttgaggtttgtaattatttttggattaatagttgatgttgttagagaaaagttggtaagagaagaattagatatttattaaattgtaagtaagtagttttaaggttaatttaaatgaggttgggagttatatttttaaagtgagtgagttttgatttatttatttaataaaaataagattttttgttagtgaaaaattagtagtttattttatttttttaatttggtgagaaaattttagtgattatgtttttgttttattaatttttttaatgagaaaagttatcgtttaggaaatttttggttttatatgaaaattgtataatatataatgttattgaatttttttagttatgttttgaggtaaggagtataatatttatgttatagttgagtagtttgagatttggatggttattgcgtggattttttttagtttttttagtttaaattttttggtggtttttagtgaataagtgataagattcggttttgattatagtttttttttgttttattttagtttttttagttattaaattgataaatatataaatagttaaaaagggtaataaaatattgttaatattattagttgttgttattgtagatatttataataagatagtaagtataagtattgaggttgtagtgttttgtatgttaaatacgttttgtttatagatttttgttttatttatttttttttttttttttttaagttaaattgtatttagttttattaaagatattttttataaataattatggtattttaggtaggatatgggtagataatcgttaatagtatataataatttttaaatttttttttttaatggattattaaaaattagaaagttattataaaatttaatgaagtttttatttgatgttttgaatagggaaagttgagagtgagggttgatattttatatttagtatgttgtttaataattttttataagttaattttgatttttaggaagtgaaacgaaaatggtagaatttatttgaagatttataatttagaaatggaattattgtttttttgataggtgttattttagtggtattattggaaagtttagattgtttgatatattggtaattaatgattaggggttaggttttaatagatgtttgggtttaagggagttaagtttatgttgaaacgtggaaagggagaagaggatataaaaataaatttgtttttttatagtataaggtttttgtgttaaggtggttatgtgtgttaaagttaaggaatttttttttttgggagttaagaggaagttttttaaaattggaagggaaaggtgttttttttatattaatttagttttggagatattttattagtgatatatgtttttttttttaaaaataataatgaagtgttttgtgtgcgaataatatagtttaaaaaaaaaaaaaaaaaagtaaaataaaattttgtatttttataaaatttgataaaagtattttaaattgtatagttattagaaatatatagttattaaaaatgtatatattttatttggtatttttagtatttttagttttttgtgtttggtttgttttggtatttttattttttgtagggttatttttttttttgttagtattagtttttttttttttttttttgggtatttttttttttttttttgtaggggtttttttaggtttgggttttggttttggaggagtaggtttagtagataatttcgcggattttttttgtggttcgttttttattttggttttattttttttagtattttttttagttttttttttgggtatggtggcggtggcgataggacgtaggtgttggacgtgggatgtagcggtacgcgggttttggtcggttcgggggtcgttttcgttttttttttatattgtttttttttttttttttttagagatagagttttatttttgtttaggtaggagtgtagtggttagattattgtttattgtagttttaaatttatgggtttaagtagtttatatatttcggttttttaagtagttaggattataggtatatgttaatacgtttggttagtttattattattattattattattatttttgtagaaatagggttttattaggttgtttaggttgaatttgagtttttgggtttaagtgatttttggttttggttttttaaagtgttgggattataggtgtgagttattgtatttagttttgttttatttttaaattgtttttgtaattataaaagtgttattttgtgtttggaaaagttggaaagttaatttttatatatattattattttaaattttattttattgtatttttttttatttttttaagtatattttggtaaagttttatttatattgtttagaaaagtttatatttaattttttttttttataggtaatggtatatttttattttattttgtaatttttggtttagttaggttttttttatatcgtttgtttcgaatttatattattattataaaagatatagaaatttgtttatattttgtttgtttgtttatgttttgttttgttttttaaaggatttaaatttttaagaatatagttgtttttataattatgatgaagtttttgttttttagagagttgtgttggggattttgtttttattggtattatatgatttttagtaattttttttttttttttttgaaatagagtttcgttttgtcgtttaggttggagtgtagtggtacgattttagatttaggttttaagttttattttttgggtttatgttatttttttgttttagtttttcgagtagttgggattataggtattcgttattacgttcggttaatttttttgtttttttagtagagacggggttttatcgtgttagttaggatggtttcgattttttgatttcgtgatttgtttatttcggttttttaaagtgttgggattataggcgtgagttattgtatttagtcgatttttagtaatatttttaaattgtatagtgttaatttaaagaattagaatattattttttttttttaatatattgttttttattttattgttaatgaagttgaataaggatatttattttttgaatattagaagatttgtagataaatgatttgagtaaaatttgagtaagttagaaaatgtttattttttagtttttttagaagaagttttgttttgttttgtttttttttgtttgagataaggttttattgtgttgtttaggttggagtgtattgacgtaattttagtttattgtaattttcgttttttgggtttaagcgatttttttgttttagttttttttagtggttgggattataggtatttgttatcgtatttggttaagttatttgtagatgatattttatttgaaggaagttggtggtaatttttatttataattaaatttaggatttttagatatgggaaaagtaagtatgatgatttataaagttttgttttaaagggtaatatattggtttaattaggtttattttataatagggaatttaggtagtttagttttatattttttttgagtttaatgatagttttttgagttgaggagttagtagtattttttttttagttaaaatttttagttgatttttttttttaattttttagtgtttattagatttgaaattttgttttgtttgtttatggtgttttgttttatggtagttttattttttaaaattatttattttgaattttagtgtgatttgtttttttagatttttgtttttgtttgatttttgaaatattaaagttttttttttttttttaaattttttttgtgattagagttataaacgttgttgtgttttgagatggttggttggaaattagtttaagttgtatttggtatagtatatattagtgaagataggttgttaggatgaagttataggttgttttatagttatagatgaatagttttttgtttttaggttttttttttattgatgtaattaaggtttttaatttagaattttttaggtaatttattatagtattattatcgatggttgatggatatgttaaggtattgattttttaagttagtagtggttggttagagtttggtaaaggagtagtttttttagtttattttagtgtgttatataaataatattttttttggatgttatagtgtgaaaaagggtgggaagtagtgttttgttgagttatattagagttttaggtaaaagaaaaaaatgtgtatttttgtatatttttttttttttaatggttaagtttttttttagaatattaaagtagttgaaaaaatagtgaaaaaaaaaaagggaagtatgtatattaaaatttattttaagtattgtatgtataagatagtttttataaataaagtattatttagttcggtatattagttgtggttagtagttgagaaatttttgtttaattagtgaaaatttgatgttttatttttgttttgatataatgaatagagagtgaattacgagacgttggaattgattaacgtagttttggtattattcgtttgtatataataaagtaaattatagattaagtaagttattaaaatttgatttattttattatgttattgtggttttgagtgggatgggatttggttaatttgaaagtagaaggtagtttttttgagattattattgatatattataagaaaattaagtttttattgaaaagtattataatgattatttttaagagaatagttattgtaggtattagaagatgattttttattattataaaataagtgtatgatttttagatgtaattaatagattgtttatatattatattagtataatttaagttgtagtttgttatttatatttataaggaatgttaggaatattaaatttttaaatatttttattttaattgtacgtggataatattgttagattgcggtgttagggttaagttttaaaagtgagttttatagaaaggtttttagaaatttggttagaaatggaattgagttaatttataattagttttttaatatgtgtttttgagatattagaatataaagagatttgttattattgaaatatagtatagatttttgattttttttgaatgtgatggggtgttttgttttgttttggtttgtatttgtttttgtttttgaggtagggttttgttgtgttgtttaggtgggattgtagtggcgtgatttcggtttattgtagtttttattttttaggtttaagtgatttttgtgttttagttatttaagtagttgggattataggcgtgtattattatgtttggttagtttttgtatttttagtagagatagagtttttttatattggttaggttggtttggaatttttggttttaagtgatttatttatttcgattttttaaagtgttaggattataggcgtagcgtgagttattgtatttagttgaatttggtgatttttaattaatgatgttttgtgtttttgtatatatttttttttttgtttttaggataaatatgttttattagatgtaatattaaatgtagttgatcgttttaattatgtttagtggtatttaattgttgtattttttaattttgattttaagtaaggagtaaaaataatgagaatgaggttatgtttagaatttcggaaaagtgttaggaagttatacgagcgattttataaatttcgtaaaaataattattatttttttataagtgagtatgttaataaaggtttttttttagtttataatgtttgggtaatattaagtaggttaaaatgttacggtgtttaaatattaaaatttatatgatatttttttggaaagttttttgttgtgttaatatttgttgtttggttaaaagaaaatatatagtagtaaaatagaaattttaaatgtttgtatttttagatattattttttagtaatgacgatttagttgtaagtagggttgaattaattttgatttttggtagtgttttaattataaaattatatcgttaatttatttttagttataattaatttaaatttaatgaatggatgggtgggtttggtgcgtttgaaagaagtattttataatagtaaaacggttaggcgcggtggtttatatttgtaattttagtattttgggaggtcgaggcgggcggattatttgaggttgggagtttgagattagtttgattaatatgtttttattaagaaaaatataaaaattagttaggcgtggtggtgtatgtttgtaattttagttatttaggaggcggaggtaggagaattgtttgaatttaggaggtagaggttgtagtgagtagagattgcgttattgtattttagtttgggtaatacgagagaaattttattttaaaaaaagaaaaaaaagaaaaagaatcgggaggtagtttttatgggttcgtgtgcgtggtatggatggagaggggtagtagagagttagtagatagagttgtgaatattgttgggcgaggtggttttgtgtagtttaggtaggtttttgagaagaagagggagttttttgtttggagttaggttgtagggtgtaatgtattaaaatggtggatttgttaagaatgatataaagattatataaaggaggggcgaggatggttatgaatattattatgttgggatataattttattttattataaaaaatatttttatttggggaaaatttttatatcggattttttaaaagtaggtataataagattgtagtaaaattaaaatttttggatgtatatattatttttttttttagaatt

SEQ ID NO: 69 - DNA, 7153 bp, Artificial Sequence
  chemically treated genomic DNA (Homo sapiens)
aattaataattttaagaattatttttaatttttgaagttgatatattatgaatttatagtaatgttattataattgggtaaagaaaaaaattttattgattaaatatttaaaagataattaagatatttgtaaaatataagtaaatgtgataagagatatttaatattgtataagtattttaatataattatttttaaatattttattaaaaagttaagaattttaggggaaataaaataattgttaatatatatttgttatatagattttattatttaataataaagtagaaagtaggattgatttaggatatagatataatttttataattgtatgttttaattataataaaaagatgatgtgtaataggttattttttttatagattagaaagagaagtttattaaaatgtttaattaaatggaaaaatattatgtaagatttatattataaagtttagattggatattaataattgagatttttaataatttggtaaattatattaatggtatttagttttttagataatttttaaggtttttattttttttttgtttaggaaattgggtaattatagttataagtaggtagaagtagtttagaggtagaggttagtaagggtagtataaatttttatgtgtaaagaatagtttttgattttaaagaattttattgtttaagaaaataataataaatttggaaaattgttttttaaattatatagtaagatatgttcgggttgggtgcggtggtttatagttgtaattttagtattttgggaggttgaggtaggtggattatttgaggttaggagtttaagattagtttgattaatatggagaagttcgtttttattaaaaatataaaaaaattagttgagtttggtggcgtatgtttgtaattttagttattagggaggttgagatagaagaatcgtttgaattaaggaggtagaggttgtagtgagtcgagattgtgttattgtattatagtttgggtaataagaacgaaattttgttttaaaagaaaagaaaaaaagatgtttaaaattggtaattttagtattttggtaggttaaggcgggtggattatttgaggttaggagatttagattagtttgattaatatggagaaattttatttttattaaaaatataaaaaaattagtcgagtttggtagtatatgtttgtaattttagttattcgggaggttgaggtaggagaatcgtttgaatttaggaagtagaggttgtagtgagtcgagattgcgttattgtattttagtataggtaataagaacgaaatttagttttaaaaaaaaaaaaaaggtatgtttatattatattatttattttttttattttttagaattaaggatataattataaataaggataaagaaaagttatatatttaaggagataatattttcggtattgtgatttgatttttataaattaagtgaatatattaaattattatatatattttaaaattatgtatattttttatgtattaataagtaataaaataaataaagataaagatttatgtggtagagagtttattattgagtttttatattttgaaaaaaataaaatgtttaaaatgggaaaaaaagttaaatatatagtattattattatgaaatgaaaagttatgaaatttttaaagaaattatttttaagaattatttaatgataaagaaatatatttatattttgttgggaaaaagaatatatataaaattatatatagtttaatttttattaattttataattaggaaaaaatatttttaagaaagttgattagtattgtatgaatgataaatttggttgattatattaatttgtattttagatttgtattgttaggaattgaataaaagaaaataaagtgggaaaattttattatttattacgaaggtttaggtatatttgatttatagattaatttttagttagttttatatattttaatttttttttaataaaaagcgaggtaggagtgttatttttttggattttacgtgtgttattttgataatagttgagatttaaaagtattaacgaatatttaaatttattttatagttttattatttttatttaaataataaaggtaagtttatattttaatttattgaggatgagtttaaggtaattttggaatttttgagaagatatttcgaaaattagggaggaaaaatttatatcgtatatgattgaaattagaagaagtaattagaggagatttttatggattttttataatttaaagtaaggaaaagatagaaagagaatttggaattttattttgttatgtgattttggatatgttttttagttttttttagtgttagtttattcgtttataaaataaagataattaataatttgtttaaagaattttaaaaagtattaaattgttagtataacgtttagtatatagtggggaatttaggaaatagtagttataaatattattttaaataataatgtagttggatagtgtatatttttaattatattagtttatttaaagtaaattttttatttaagtaatattgggtttaaatttattgagtttaaagtgattattatattattatattattgtattaattatataagattggagttaatgaatgtattgttaagtttttgaatgaatataggtataaaattattgggttgaaaagttttaattttaaatagagaataaaaggatggagaaaaaagatttttttgttatttaaagagtaaatttaaaaattaaaaagacgtaaagaagaaattaaatggggggaaaaatagtaattattttataatggtatttagaggggatgaataatttatattagtcggggtttagtttggataatgaaattgggaggaagaggtttttttttttgtttttgtttttgtttttgagatagggtttcgttttgtcgtttaggttggagtgtagtggcgcgatttcggtttattgtaagattagtttttcgggtttacgttatttttttgtttcggttttttgagtagttgggattataggtttttgtaattatattcggttaatttttttttttgtttttttagtagagacggggttttataatgttagttaggatggtttcgattttttgattttgtggttcgttcgtttcggttttttaaagtgttgggattataggcgtgagttatcgtgttcggtcggaagaggtttttatatagggttgtttatttgtgatttttatttattattttttattaagaaaatgatgattgtaatataaattttaatttgaaagaaagtatagtattattattatcgtatcgttatttgtgtatattagtgttagtgatatgttttaggttttaaatgataaatttaattaaatgttgtaaatattaattggcggattaaatttttataatttaagtattttaagtttttatataaatttattagttttgaatatttaataaaattttgaattttgtgttttagaattgaaatgcgagttaagttttatttatttaataagattatatattttttatggtggggattatttaaaaaattatattattatttaaagagaatttttataaattttataatttcggatattatgttttaatagtatgtgttaacgtatttttttagaatgtaaatattggtgtttgttatgaaatttttagtgcgttttaataagagtttttttttaattagttaagtaaaagatgttgggtggatgtaattatggttatttaaaagaatgttggtatatatgttttgtaaattatttaagaaggaaatattataataggaatgaattagtataaatttattaatattaaaatatatgtatgtattcggttaatggtggatttcgttttatgtgtagattatgatatttttatgttttaaaatgagtttgggattgtgggcggaggttggaaggttgacgagtaaggatgtggaaagcgggtattattagggttggagattttttagggttgttatcgattgaaagtgattttatgtgttttaataaaggaagttatgaaagtttggtataggagttttaaaagtaaggaatcgaatataatgtaagtgtgcgttgaattcgttagaataggagtacgtttgagggtaagggtttttgtttgtttttattattgttataaggtaggcgttttgaatggaacgtggaggtttgtaacgtatttagcgatacgtatttattttaggagataagggtaatatatattgtttaaaaattttatcggaataaattatagcgacgatattataaaatatttttattttaggttttattatttaagaggaaagttttagaatcgagagttttgtgaaatcgtttgtgttttttcggcgagaagttttttagtatttttaggttcgtttcgcgttttttcggttttcgtttcggcgtaaggtaggtcgagaatcgttagttgcgttttcgggttcggttttgattgacgggcgtttcggattattataaataacgggttttcgaagcgtgggttcggtttagcggacgtagacggttcgtatttatcgcgtcgtagttcgttttatagtttatagattatagttcggggcggggtaaggggtttcgggtacgagtgtgggttgtgaaaatacgggtataagtttgggtcgagtatcgatttgggcgtttcgtatttttttcgcgtaatatcggtttttgggtagcgtaattgtaaggataggaatcgtcgcggcgcgtttttagttttttttttattttttttcgttcgatttgtcgcgcgttcgcgttttttttttaattttaaaggattttttcggggttggaaaacgtttttttttcgttttttttttgtgcgcgtgaattaggtagttgttagatttcgcgagaggttcgttttttagtcgtttttttttttagttagtgagtgcgcgaacgagaaaggaggagggcgttttaggcgatagtattgtagacgttattattttttgtttttttgttgtatcgatttcgacgttttgtttgtgttttatttgttcgcggtttataggtaattggagttattggagtttgggtattgttgattcgggtaagggttggggttttttgaaaggttgcgtttattttttttaagttcgggttttttcgagtttttagtggttttttagttcgaagggaggcgttggcgggaggcggggttgtcgtttttttcgtcgttttgattgacgtggtttcgggttaatcgtttcgttttcgtattatcgttgaagttttggtagttaatagggcgcgacggcggggaggacgcgagaaggcgggggaggggagtttgcgttcgttttttgtttagtttcgatcggttgaggcggcgcggtagcggagggacggtagtttcgcgcggtgaggagtcgggttgggggagcggttcgtggaggtgagggtcggagtttagttttttcgtttgagggaggcgttttgggagtcgttttggtgtttggtcgttttttcgagtgggaacgttgttcggtgtttttttttttattttcgttatttttttgagcgtgtattcgtagttcgcgttgtggttttagagatttggggattcgtgaggtatgtgtttttaggatgagttggagttatgtggtattgggaattagggatttcgtggaggaaaggaggtcggtgcggggagaaggtcgcgtcgtcgttttttttgtgtgagtttcgttttattttgggtttttcggttcggggtcggagttggagcggcggggatggaacggttagggttgtttcgatggttttgtttcgggtagtggggggaggatgcgggggatgagatttcgggatcgcgtggtgggtgggggagggggtcggcgttcggtttcgtttagtagtacgtagtcgttattacgcgggtcgttattttttgtcggattcgggtgaggagaggtgcggtgtttttgttgtcgattttcgttttttttcgttttgttattcggttgtttttgatttcggtgtcgggaggcggggaggggagggcgcgttggcgttcggttagtggagtatatatttagcggatttttgaggtttggggattagtgattgtaggattcgaagggtgaacggtaagcggtaacgttatttttatagataagttttgttgtttttgtttaaatttttttatttaattttttttttattatattttagaaattgcgtgttgggtcggaaggatgtcgttttagttgtcgttaggagagtaataagtcgattaacggtatgggagaatgggaggtataaatgtgtttcgtttgttggttttttgttgtttagttaattttttagtagaggtcgtttgttaatttttagtttcgataagagggaagtttaaaaaggttgtttgtagttttatcgatcgttttggtacgtagatattttagttttcgtgttataggtatgattgttgtgttgtatttttttaagtttaatttaaaataattcgttagtgattgttagtttttaagggttttatttgtttcgttgattaataatagattggtattgtggtagtttgggtttggttttatattagatttttggatttattttttcggtagattgttttggttgttggatgtgttcgtaattgtcgttgtatttgtaaattttagagatgttatataagatcgttttaagtatgagtcgaaagaaataggaaagtaattggaagttttaatataaaattagtttttttagtgaataagatgtattgtaattttttataaatgtatgttttgtggatgatatttatttttttagggttttgggaatgtgtcgtataaaataatttattgttgtggtgggatttaatttagtggttaaaagttattgttttaatttagtaaaaaatgaaattaggtttttttgaattttgtattttttaggtagttatttgaattgtgaaattttaaaatgaagaattaagttttagaaatagttggttttttgggtttaaattagtatttattgtgatcggaaataaatatttagtaataagaataaataaaagtaaaattgatttgtgttggtttttatagg

SEQ ID NO: 70 - DNA, 7153 bp, Artificial Sequence
  chemically treated genomic DNA (Homo sapiens)
tttataagaattaatataaattagttttgtttttgtttatttttattattgaatatttgttttcgattatagtgaatattgatttgaatttaaaaaattagttgtttttaaaatttgattttttattttagggttttataatttaaatgattgtttaaaaaatataaaatttaagggagtttggttttattttttgttaagttagaataataatttttagttattggattaagttttattatagtaatgaattgttttatacggtatatttttaaaattttgaaaagataaatgttatttataaagtatatatttatgaaaagttataatgtattttatttattgggaaaattaattttatattaaaatttttaattgtttttttatttttttcgatttatgtttgaagcgattttatgtgatatttttaaagtttataaatataacggtaattgcgaatatatttaataattagaataatttatcggagggataaatttaaaaatttaatataggattagatttaaattattataatattagtttattattaattagcgaaataaatggagtttttgaaaattaatagttattagcggattattttaaattaggtttaagggagtataatataataattatgtttgtaatacgaaaattaaagtgtttacgtgttaaaacggtcgataggattataaatagtttttttaagttttttttttgtcgggattaggagttgataagcggtttttattagaaggttggttagatagtaaagagttaataagcgaggtatatttatgttttttatttttttatatcgttggtcgatttattgtttttttaacgataattgaaacgatattttttcggtttagtacgtaatttttgaggtgtggtgggagaagagttggataagaaagtttaagtaaaaatagtagggtttatttgtaagaataacgttgtcgtttgtcgtttatttttcgggttttgtagttattagtttttaggttttaaaaattcgttaagtatgtgttttattggtcgagcgttaacgcgttttttttttttcgtttttcggtatcgagattaaaaatagtcgggtaataggacgggaaaaagcgaaagtcgatagtagaagtatcgtatttttttttattcggattcgataggaaatggcggttcgcgtaatggcgattacgtgttattaggcggagtcgagcgtcgatttttttttttatttattacgcggtttcgaggttttatttttcgtattttttttttattgttcgagataaagttatcgaggtagttttgatcgttttattttcgtcgttttagtttcgatttcgggtcgggagatttaaggtgaggcggggtttatataaagagagcggcggcgcgatttttttttcgtatcggtttttttttttttacgaggtttttagtttttagtgttatatagttttagtttattttagaggtatatgttttacgaatttttaagtttttaggattataacgcggattgcggatatacgtttagggaaatggcggaggtgggggaggggatatcgggtaacgtttttattcggagaagcggttaaatattaaagcggtttttaggacgttttttttaagcggaaaaattgggtttcgatttttatttttacgagtcgtttttttaattcggttttttatcgcgcgagattgtcgttttttcgttgtcgcgtcgttttagtcggtcggagttagatagaaaacgagcgtaggtttttttttttcgttttttcgcgtttttttcgtcgtcgcgttttattggttgttagggttttagcgatggtgcgagggcgaagcgattggttcgaggttacgttaattaaggcgacggaggaggcgataatttcgtttttcgttagcgttttttttcgggttgggaggttattaagggttcgagaaaattcgggtttgggaaaagtaaacgtagttttttagggagttttaatttttattcgaattagtaatatttaagttttaataattttaattatttataggtcgcgaataagtgggatataggtaagacgtcgaggtcggtgtagtagagaaatagaggataatggcgtttgtagtgttgtcgtttggagcgttttttttttttttcgttcgcgtatttattagttggggggaggggcggttagggggcgaatttttcgcgagatttaataattgtttagtttacgcgtatagggagggggcggggaaggggcgttttttagtttcgaaggagttttttggggttggaggaggggcgcgagcgcgcggtaaatcgggcgggaagaggtaaaaaaggaattgggagcgcgtcgcggcggtttttgtttttatagttgcgttgtttagggatcgatgttgcgcgaggaaaatgcgggacgtttaggtcggtgttcggtttagatttatgttcgtgtttttatagtttatattcgtgttcgaagttttttatttcgtttcgggttgtggtttgtgggttgtgggacgagttgcggcgcggtaagtgcgggtcgtttgcgttcgttgggtcgggtttacgtttcggaaattcgttgtttgtaatggttcggggcgttcgttagttaaggtcgggttcgggggcgtagttggcggttttcggtttgttttgcgtcggggcgggagtcggggaaacgcggggcgagtttgggagtattggagaatttttcgtcgagagggtataggcggttttatagggttttcggttttgagattttttttttgggtaatgggatttgagatggaagtattttgtagtgtcgtcgttgtagtttatttcgataaaatttttaggtaatatgtattgtttttgttttttaaaatgaatgcgtatcgttgaatacgttgtagatttttacgttttatttaaagcgtttgttttgtggtagtgatgaaaatagataaaaatttttgtttttaaacgtgtttttgttttagcgggtttagcgtatatttgtattgtattcggttttttatttttaaggtttttgtgttaagtttttatgattttttttgttaaggtatataaggttatttttaatcggtgatagttttgggaaatttttagttttggtagtattcgttttttatatttttattcgttaattttttagttttcgtttataattttaaatttattttgaagtataaaggtgttataatttgtatataaagcgaaatttattattggtcgaatatatgtatatattttagtgttgatgaatttgtgttgatttatttttgttataatgttttttttttgggtaatttgtaaaatatatatattagtatttttttaaatggttatgattgtatttatttagtattttttatttgattgattagaggaaaatttttgttagggcgtattgaggattttatgataaatattagtatttatattttgggaggatacgttaatatatgttgttagaatataatgttcgggattgtggaatttataaaagttttttttaagtgataatataattttttaaatggtttttattatgaagagtgtatagttttgttgggtaggtaaaatttaattcgtattttagttttaaaatataaagtttagaattttattaaatatttaaaattgatgagtttatgtaggggtttaggatatttggattatagagatttaattcgttagttagtatttgtaatatttaattgagtttgttatttaaaatttgagatatgttattgatattaatatgtataaatagcggtacggtaatgatgatgttgtgtttttttttaaattaggatttatgttgtagttattatttttttgataaggaatgatgagtgggaattataagtaagtagttttatataagaatttttttcggtcgggtacggtggtttacgtttgtaattttagtattttgggaggtcgaggcgggcggattataaggttaggagatcgagattattttggttaatattgtgaaatttcgtttttattaaaaagataaaaaaaaaaattagtcgggtgtggttgtaggagtttgtagttttagttatttaggaggtcgaggtaggagaatggcgtgaattcggaaggttgattttgtagtgagtcgagatcgcgttattgtattttagtttgggcgatagagcgagattttgttttaaaaataaaaataaaaataaaaaaaaaaattttttttttttagttttattgtttagattggatttcgattggtgtaaattatttattttttttagatgttattgtgggatggttgttatttttttttttatttgattttttttttacgtttttttaatttttaggtttgttttttaaataataggaaagttttttttttttatttttttattttttgtttgaaattaagattttttaatttaataattttatatttgtgtttatttaagaatttaataatatatttattgattttagttttgtgtaattggtataatggtgtaatggtgtagtgattattttggatttagtgaatttagatttaatattatttagatgggggatttattttagatgggttaatataattgagaatgtatattatttagttgtattattgtttaaaatagtatttataattattattttttgagttttttattgtgtgttaaacgttgtgttggtagtttaatattttttagagttttttgagtaagttgttagttatttttgttttgtgaacgaatgaattagtattaagagaagttaaggaatatatttaaggttatatagtaaaatggggttttagattttttttttgttttttttttattttaggttatggaggatttataaaaattttttttgattattttttttaattttagttatatacggtataaattttttttttttaattttcggagtatttttttaaaaattttaggattattttgaatttatttttaatgaattaaaatgtagatttatttttattgtttagatgaagataatggaattgtggagtagatttaaatattcgttagtgtttttaagttttagttattgttagaatgatatacgtaaggtttaaaaggatgatatttttgtttcgttttttattaaaaaaaaattggaatatatgaggttgattgaaaattaatttgtaaattaaatatgtttagattttcgtggtaggtgataaaatttttttattttatttttttttgtttagtttttggtagtatagatttagaatgtagattagtgtggttagttaagtttattatttatataatgttaattagtttttttaaaaatgtttttttttgattataaaattaatggggattaagttgtatgtaattttatatgtgtttttttttttaataaaatgtgaatgtatttttttgttattaaataatttttaaaaatggtttttttaaagattttatagttttttattttatggtggtagtgttatgtatttaatttttttttttattttgaatattttgttttttttaaaatataaaaatttagtggtaaattttttgttatataaatttttgtttttatttattttgttatttattgatgtataaaagatgtatatagttttggggtatatgtgataatttaatatatttatttaatttgtaaagattaaattatagtatcggggatattatttttttaaatatatggtttttttttgtttttatttatgattatgtttttaattttggaaagtaaaagaagtggataatatggtatgaatatattttttttttttttttgagattgagtttcgtttttgttgtttatgttggagtgtagtggcgtaatttcggtttattgtaatttttgttttttgggtttaaacgatttttttgttttagtttttcgagtagttgggattataggtatgtgttattaagttcggttaatttttttgtatttttagtagagatggggtttttttatgttggttaggttggtttggattttttgattttaggtgatttattcgttttggtttattaaagtgttgggattattagttttgaatatttttttttttttttttttgagataaagtttcgtttttgttgtttaggttgtagtgtaatggtataatttcggtttattgtaatttttgtttttttggtttaaacgatttttttgttttagtttttttagtagttgggattataggtatgcgttattaggtttagttaatttttttgtatttttagtagagacgggtttttttatgttggttaggttggttttgaatttttgattttaggtgatttatttgttttagttttttaaagtgttggaattatagttgtgagttatcgtatttagttcgaatatattttattgtataatttaaaagatagttttttaaatttattattatttttttggatagtggagttttttaggattaggagttgttttttgtatatgggaatttgtgttgtttttgttaatttttgtttttgagttgtttttatttgtttgtgattatggttatttaattttttaagtaaagaagggatgaaaattttaggaattatttgaaggattagatgttattaatataatttattaaattattaaaggttttaattattaatatttagtttaaattttataatatagattttatataatatttttttatttgattaaatattttaataagtttttttttttaatttgtaggaaaaataatttattatatattatttttttattataattaagatatgtagttgtaggaattatatttgtattttagattaattttattttttattttgttgttaagtgatgaaatttgtgtaatagatgtatgttagtagttattttattttttttaaagtttttgattttttggtaaaatatttgagaatagttgtattggaatgtttgtatagtgttaagtattttttattatatttgtttgtgttttataggtgttttggttattttttgggtgtttagttaatggaatttttttttttgtttagttatgataatattattgtaaatttatagtatgttagttttagaagttgagagtggtttttagagttattaatt

SEQ ID NO: 71 - DNA, 8842 bp, Artificial Sequence
  chemically treated genomic DNA (Homo sapiens)
tttttattgggagttttttttttgatttaattttaatagaggtatttttttttaagtgttgtttgtaatttagtttttaatgtttgaagatatatttttagttttttttttgacgtttttttgtttttttaggaggtttttggagggaaggattttatattggttttttgttgagtggtttagttttggtttatgggatacgtgtgcgtttgttttgtttagtatacgttggggttgttattatttttagagtagtgtaggtttttggcgttattatttaagtgttttgttaatttttagggtaggagttagagttttatttgtaggtgattttggtttttttaagattgagttgatatttgtgtttttagtaaatatgtttttgagtatttttgaatttatttgttaagtttggtttggaaagtgtgaagggagagttggggttcgtagttggaaagatttttattttttgttttttttttgaatttatttgatgttttttttttggttaaggggtaaatttgtatatgtaagttttatatattttggttttttatggaattggtttttgtagaagtcgggttagaaagaatttagtatttttttgtattataatttattgagtttttattttgtgttaggtatcgttttaagtagtttatatttaagattggatggatttttattatttttatttttatttcgagaaagagtatttttttttaagataggaaaaatagttagggttataaaggagggttttttgtgatattattagaagtggagaagaggtatttagattttattagtaaagtgtagtcgaagagttatgttaagtttattgtgttcgttgcggtattgttttttttagtgttggttgttattatataattttatagtttgtgtggtttaaatagtagatatttatttttttagtgttttggaggttggaagtttgagattaggatgttaatatggttaggtttagggagggttttttttttggtttgtagatagttgtttttttattgtgtttttatatgggtagagagtgagtgagagtaagttttttggtgtttttagttttttatcgaaattttattattttacgaaggttttatttttaaatattattacgttgggggttagggtttaatatatgtatttggggggatattatttggtttatagtaggtattgttcgggttagaaggttttttagggatttagttttgaggttggttgtggaaggtgtttttgttttattatttttgtatttgttttattgtaagaattgggtagatagattggtagtttaggttaagtaagatagatggtacggaggttcgataggaaggtttttggagattaggaagataggaattaaggaaggtgaagaggaagaaaaaaggattttatgaagaggagagggtttttaaaagttggaaatataagtgaggaggtgagaattagtttgaagtatttatttgtgatttggtgggggtaggaaggtgttagaggagttagggagttgattagacgggaggaattttttttattttttatggaggtagattatcgttggtttgtaattggtatttttagagttaggaattattgtgtttatttttttagattttttttattggtgatgatttgattttttttttttgtattaatgagtaaggtggaggaaagagattttttttttttatatatatattattttatttaatgtttattaattttaagaggtaggaataattgggttacgttatagtgaattgtttttttgtaggttaaaatttaaatgtaggtgatgttatagagtttaatttagtattattattaatgttattatatagattaggagattgaggtttcggaaggttaagttatttgtttaagtttatatatttggtgagttagggagtttggatgtgaattggggtttaatttttaaatttgttgtggtaggttgttatttatggaaataggggtttttgcgggaatgtgtaagagatgaggttggtaagtatgatttttagatgttaggagttgatttgtgtggttattaatgggaagtttttgaagatagaaaggtagagtagtaaagtagaattaatagggaagggatgaggaggtcggagggtaagtaggttattgcgagattaggacgaaatttattgggatcgtgagatgttggaaggaaggattagagaatttgggattatgttttgtatttttttgttgtaataaatggtattgtatgagatattatttattgttatgtgtttttattgtagttatttttgtaatttatatgataagaaaaaatgatagggtgatttttatatatgtgtatatttatttatatattttttagattaggagcggtgatttgagtttattagatatgtttaattaggtaataattaatttaggttattaaattgattatttaaattaatttaggaaattgatgattttaattaaggtaaatatatataatgaaatatatgtagttgttagaaagggttagattttatatattaaaatggaaagaaagttttttgaaatttaagaaaattgtgtttttattatgtgagtagaaattttgtgtatatagaaaaatggttttttttttttttttttttttttttttcgttttttgagacggagttttgttttgttgtttaggttggagtgcggtggcgtgatttcggtttattgtaattttcgttttttgggtttaaattatttttttgttttttgagtagttgggattataggcgtgcgttattatgtttagttaagttttttgtatttttagtagagataggggttttattatgttggttaggttggttttggatttttgattttaggtgatttgtttatttcggttttttaaaatgttgggattataggtatgagttatcgtgtttagttagaaaaatggttttttaattggaaatgtaattttagagaataaagaatagaattatattgtaatatgataagtaataatatatataagcgttaaaggattttttttttttttttttttttgtttttcgatatttgaggggtaggtttcgtggagtttttaggttgagaggttgagattggtagagtaggttgggttttggattttgatatttttgggtaggagtgttttaaagattgagatattatgtttattttttggggtttttgtttttggtattatatttagtatatagtagttgttttataaatatttattaaataagagtagaattaaatatatttggttagaaattgtttttaggtagtaaggaattaatacgtggaaaatatggggtttttggagtagtgttaatgtaagttagtttttgtaatgtatatagtgatatttattgttaatgatacgtgttggagtttttttattgttgattttttatatttatttatttttgtttttaagtggatgttggtggaaatttgaggatatatttttgtgtagtagatagtatttgtaagtaaatttgtgtaggtttagggttatattgataaaaatatatgagagtaaatatatatagaagttgttttaagaatttttgatgttttagatgttttgatttttggaagttttattttatatcgtagtaaatatattaaaatatttttatattttttaaatatttttaaataatgtgagtgttaaaataatagttttatttgaaattatttgatgttgcggaatttattttttaatgattatgatttttcggtaattacggtattagggaatttatattaagtgatgtttaagttatagttttaaaatataatgaaatatttatttattaatatattataattatgaaattaatatgttttggggatttttatttaaatatttattaattttagatttgtagtatattttttgtattgtgtagttaataaaatttttagttttaaatatttttataggtttttgaaaagtttaacgtaaaaaatagtttttatgtgtgattttttattgggtaataaaagttaatcgcgatttttattttttttttattttagggtttttttaggatagaacgcggaaacgttttttttttcgtttttagggatttttttttttttttagtgtcgtttttttttttttttattttatttttataataaatgttagtgtatatttaggagcgggtggttttataggggatattttaacgtttatttaggagcggttggttttatagaggattttttaacgttgacgttttttggagaaaaggatttgtgatgaaaatttttttaaggggattttttagcgtttagtacgttcgatgtttttgttttagtcgcggttttagcgggtagtggttttttttgaagttgggatttttttgtttttttcgggtagcgtaggttatcggtgattcgggacggtttgtaaacgattttcgcgttttcgttttcgtggaataacgcgcggcgggtattattgtttaatatttagcgttcgtgaaggcggagatcggcggggtagttagtttttggttgtggattttgattaatgggtcgtaggcgtacggtttgtatcgttcggttcgttgttagtggttcgttcgggagtcgtcgtattttcggggttgttcgttcgagtcggtttggaaggtagaggacgtttttaggtcgtttcgcggggttttcggaatttttgggaaagtttttttgtagcgtcgtttttggattttaggtgtgaggagcggggttcggttagcggttttagaagaggttcggattttattgtcgtggttgtcgggggcgggaaagtgatttttcggaaagtagagtatttcgaagaaggcgggtcgcgcgagttaagttgacgttattggtcggtgtggtcgtcgttttgcgtatcgttcgttttttttacgattttttttaaggtcgcgcgatcgttggcgtatcgtttggagcgcggtagtaagcgtgggaacgcgggcggcgagacggcggtaggacggcggtaggtaggtatagtgggcgggtagggcgttcgtgtttcgcgcggttcggtttcgcggggttttcgacgttaggcggggcgtgggggtggaattatttatcgtaatgttttcgggcgtagtttagtggttattcgtgtttttttttgttttttgtttattttttagttatttaagtttaatttgaatgtttaagtcgttgattgtcgtttgtttgtttttaaagattggtagatagatgtttttttaaaaattttatttttttttaaatttggtttatatggaaaacgttaggagagtttatataatgaacggtaatagtaattttttattttgaaacgcgttttattattttattgaaattttattacgtggaataatgtttggagggttagagttgtggaattgtttaataattaatcgttattgagggttagtttgtgaaggaggggatagattgtttttaaaattttgtttaatgatagttaattaagatttttgagtttggtttgagggtttttgtttttattatagtttagtcgtttttggtaagagagtttgtatatgggttatagtttataaaagtattgtttgaaaaaatttattgaaagaatattgtttgtaaaatgagttttaatatataggatagatttttttaaggtgagatgtgttatttatttagagttgtgaaaggttttacggatggaaattagagattgaattttttagaattttaagaagtttttttaattaatggttttttattttttttttttaaattaaaggtaagaattggtagttaaaatgatagtttaaagtttgtttttttgggttacggtagttttttttatgaaaagatttgggagtgatttagttatttgaggaaggttggtgttagagagagaaatggttttggtgttttttggtttagtgatgcgggtatgttaggttagagcgagtgttttgggtttttcgaggcgggggagagggtggggtttgttgttgttagtttaggtgtgatttgtaatttggattaggtgggtttagggtaattttttattacgttttttttggaaagtttgattgttgtatatatttttagggttgtagatagggtttggttaatagattattttaaaattaagaagaggaagttataaatatgtgattagatttattaattttttttggttgggtatttggtggaattcgtttgttaatgtttaataaattattatggattataattgtagtagaattttaggtttttgatgttatttagaattttggaggagattacgaaggatatatagacgtggttgtatatgtgtagagattttgtaatgtaattatggtttttttttgtattatgtgtgaaataagttgtcgttggcgttggggcgtcggtttgggttttaatatagttcgttggttgtttcggtatttgtcgtgtttttttgggttttagtttttttttttttaaataaagaggggattggattagatgatttttaaagtattttttagtttttagatgttatgatttatttttttttttttttttttaaaattttttttttttgtaaattattaagatagttgttttgaatagtttagatgttatgaatttattaggaattttgataagaaagtgttgattttttttttagaaaaatgcgtgtattaataaaatttttgtttttggttgtaggaggtttaggaattgtggattttagtttaagaaatttgtagtaaggaaattaggggagttgaaagttttagaagttaatttttatgttgtgttttggttatttttgtgtagtttattttttaatttaggagaaatttttttattttgttttaggaaagagttgttaatttgttttcggggagtgtgggggggtttttggtattggtgttttatttttttttttaggtatttttttttaagtttgttttttttttatgataaatatagtggtttgttttagaattttgggttttttgagatatagttttttaatttataggtgaggaagttttagggagaggtttaagtgacgttataaggtttggttagagaaaagtttttgttagagtttagagtttttaaattaaggtttaatttgggtgggcgtagtggtttatatttgtaattatagtattttaggaggttgatgtgggaggattatttgaggtcgagagtttaagattagattgggtaatatagcgagattttgtttttaaaatgtatatttgggtgtggtggtatatgtttgtagttttaggtatttaaggggttgaggtaggaagatcgtttaagtttaggagttttaggttgtcgcgagttatgatggtattattgtatttttgtttgggtgatagagtaagattttgtttttaaagaaaaaaaaattgaatttatttttttttaaatttataaacgtataattgaggttgttggatggggaatttaagaaattttatttttttttttttgggatttggttttgtttttcgttttatggttatttgtagggtggttgaagtttttagaatgcgtattttttgtgaaggttttgattgatattttgttttttggattagtgtggttttattatattttgggatgttatgttttgttattgttgattgttttaaattcgtttgtttaaagaggttatattttaattagaagaataaaaatgttatttttttttttttttgggtgggcgtttatttagttgttttggggatttttagtattgtttttggaaatgttggttttaagtcgataggttatgttagttttttttttttttttttgtgttgttggggaagttgtttgtttgggtgagagtgtttttttaaaggatgtttttgggtgttttgggatggttaggtttttagagtgggatatgttttggaagaggagtttagtgaattttgttttgttcggtagttgtagtttatttttttatttttgtttttattttttagttggtcgtaggagttgtttaggaaggaagtttggataataataatgatatttggcgtgtaaggtttaggttttgttttagttgtttttcgtgtagtatttgaatttttttataattagtataggtagtgttttgttagttgtatttgggattgggtagttgatgttttgagtttaaatgttgatttagcgttttttagttgagcggtggcgggatttgaatgagatcgcggttttgttttatttttaaattgttgtttttattattgtgaaggaatagttatttagatgggttggtttgagggtttttttttttttagacggtacggacgtagtattttattagggaatgtggggttagttgggtatttggtagtttagttggtttttcggataatgggttgtttagtgaaggaatttggtgttgtaaaagtgattttttttttttttttagttttgggttaaaattggagttgtttattgtggttgtatttgtttgaaaggaaagggtagatgaaagttggaaggagtatagttagtatagtgggaggggtttgtagggggttgttggtggttgtaggtggttgtaggttttttacggagtttttagtttgtatttagggttgtgaggttatggaggttagtattgtttttttatggtaggtgtttcggagtttttgaatttgtgggttttttttaagttagtatttttgttgtaaatttttgagttttttgttagtagtttttgggttgttgtgatgaatgagataatattcgtaatattatagcgtgtatttttgtttttttaagg

SEQ ID NO: 72 - DNA, 8842 bp, Artificial Sequence
  chemically treated genomic DNA (Homo sapiens)
ttttggaaagatagaaatatacgttgtgatattacggatattgttttatttattatagtaatttaaaaattgttaataggaaatttagaggtttgtagtaaaggtgttggtttgggggaaatttatagatttagggatttcgggatatttgttatgagaaggtaatgttggtttttatgattttatagttttgagtgtaaattgaaagtttcgtgggaaatttgtagttatttgtagttattagtagttttttgtaggttttttttattgtgttggttgtgttttttttagtttttatttgttttttttttttaggtagatataattatagtgaatagttttagttttagtttaagattggaaggagagggggaattatttttatagtattaggtttttttattgagtagtttattattcgaagaattaattgggttattagatgtttagttggttttatattttttgatagaatattgcgttcgtgtcgtttgggaaagaggaggtttttaggttagtttatttaaatagttgtttttttatagtgataagagtagtagtttgagaatgagatagaatcgcgattttatttaagtttcgttatcgtttagttgggagacgttggattagtatttaaatttagggtattagttatttagttttagatgtagttaataaaatattatttgtattggttgtaagagaatttagatgttatacggaaagtaattgagatagggtttggattttatacgttagatgttattattattatttaaattttttttttgggtaatttttacgattaattgaaagatagggataagagtgaggaaataaattgtagttatcgaatagggtaaagtttattgggttttttttttagaatatgttttattttagggatttaattattttagggtatttaaagatattttttggaagaatatttttatttaagtagatagtttttttaatagtatagagaaagagagagagaattagtatgatttatcgatttagagttaatatttttaagaatagtgttggaaatttttaagatagttggatagacgtttatttaaaaaaaaaaaaaaatagtatttttgtttttttgattaaaatgtgatttttttgggtaaacgagtttgaaataattagtagtaataagatataatattttaaaatatggtagagttatattggtttagaaagtaaaatattaattagaatttttataagaagtacgtattttggaaattttagttattttgtaggtggttatgagacgggaaatagggttaggttttagggaggaggaggtgggattttttaaattttttatttaataattttagttgtgcgtttatggatttaaaaggggatgagtttaatttttttttttttagagatagggttttgttttgttatttaggtaggagtgtagtggtgttattatagttcgcggtagtttggaatttttgggtttaagcgatttttttgttttagttttttgagtatttggaattatagatatatgttattatatttagatatatattttagagataggatttcgttatgttgtttagtttggttttgaattttcggttttaagtgatttttttatattagttttttaaagtgttgtgattataggtgtgagttattgcgtttatttaaattagattttggtttgaaaattttgaattttggtaaaggtttttttttaattagattttgtgacgttatttgaatttttttttgaggtttttttatttgtaagttgagaggttgtattttaagagatttagaattttaaagtaggttattgtgtttattataaagaagggatagatttgggagagggtatttgagaagagaaatggaatattaatattaaagatttttttatatttttcgaaaataagttagtagtttttttttggggtaaggtagaaaaattttttttagattgaggaatgagttgtatagaggtggttagaatataatataggggttggtttttgagatttttaatttttttgatttttttgttataagttttttaaattagaatttatagtttttgagttttttgtaattaaaagtaaaaattttgttagtatacgtatttttttagaaagagggttaatatttttttattaggatttttaatggatttataatatttaaattgtttaggataattattttggtgatttataggaaaaagaaattttaaaaggaaaaagagaagagtaagttatagtatttgaaagttggaaaatattttagaaattatttaatttagttttttttttatttaagagaggaaaaattgaggtttagagaggtacggtaaatatcgaggtagttagcggattgtgttggaatttaggtcggcgttttaacgttagcggtagtttattttatatatggtgtagagaaaagttatagttatattataagatttttgtatatgtgtagttacgtttgtgtgtttttcgtggttttttttaagattttaagtaatattaaaagtttgagattttattatagttatgatttataatgatttattaaatattaataaacgaattttattaaatgtttagttaggaaaaattaataagtttaattatatgtttataattttttttttttgattttgaggtaatttattggttaagttttatttgtagttttagaaatgtatatagtagttaggttttttaggagggacgtgataagaggttgttttgggtttatttaatttagattataggttatatttgagttggtagtagtagattttattttttttttcgtttcggagggtttagggtattcgttttggtttagtatattcgtattattagattagaaagtattaaagttatttttttttttggtattaattttttttaagtgattgaattatttttaaatttttttatagaggaagttgtcgtaatttaaaaggataagttttgaattgttattttaattattagtttttatttttggtttaaaaaaagaaagtggggggttattggttggggagattttttaaaattttggaaaatttagtttttagtttttattcgtaaagttttttatagttttgggtaagtaatatattttattttaggaaagtttgttttatgtattgggatttattttataaataatgtttttttaataaatttttttaaataatgtttttgtgagttgtggtttatatatagatttttttgttaaggacgattgggttgtgatggaagtaaaggtttttaagttagatttagaaattttaattgattgttattaaatagaattttagaagtagtttgtttttttttttataaattaatttttagtaacgattggttattgggtagttttataattttgattttttaagtattattttacgtggtagaattttagtgggatgatagagcgcgttttaagatagggggttgttattgtcgtttattatatgagtttttttaacgttttttatgtaaattagatttaaagaaaaatgagatttttaaaaaggtatttatttattaatttttggaaataggtaaacgataattaacgatttgggtatttagattggatttaggtggttggaaaataggtaaaaagtagagagggatacgggtggttattgagttgcgttcggggatattacggtaggtagttttatttttacgtttcgtttggcgtcggggatttcgcgggatcggatcgcgcgggatacgggcgttttattcgtttattgtgtttatttgtcgtcgttttgtcgtcgtttcgtcgttcgcgtttttacgtttgttgtcgcgttttaggcgatgcgttagcggtcgcgcggttttaaaaagggtcgtgggggggacgggcggtgcgtagagcgacggttatatcgattaatagcgttagtttggttcgcgcggttcgtttttttcgaagtgttttgtttttcgagaaattattttttcgttttcggtagttacggtagtggggttcgggttttttttggagtcgttggtcgagtttcgttttttatatttggggtttaggggcggcgttgtaggggggtttttttaggaatttcggaggtttcgcggagcgatttggaggcgttttttgttttttaggtcggttcgggcggatagtttcgggagtgcggcggttttcgagcgagttattagtaacgagtcggacggtgtagatcgtgcgtttgcggtttattaattagaatttataattagaaattagttgtttcgtcggttttcgtttttacgagcgttggatattgggtagtgatgttcgtcgcgcgttattttacggggacggggacgcgaaggtcgtttatagatcgtttcgggttatcggtggtttgcgttgttcgggaggggtaggagaattttagttttaaaggaggttattgttcgttgagatcgcgattgaaataggagtatcgaacgtgttaggcgttagaaggtttttttggggaaatttttattataaatttttttttttagaaagcgttagcgttaagaggttttttgtgggattagtcgtttttgggtgggcgttaagatgttttttgtgggattattcgtttttgggtgtgtattgatatttattgtaaaaatgaagtgggggagagggagaacgatattggaaaaagaaagaaatttttggaaacggaaaaagaagcgttttcgcgttttattttggggaagttttggaatggggggaaaatgagggtcgcgattggtttttattgtttagtagagaattatatatgggggttgttttttgcgttgagttttttagggatttatgaaaatgtttgagattgaaaattttattgattgtataatataaaaagtatattgtaaatttgagattaataaatgtttaaatgaaggtttttaaaatatgttaattttataattgtaatgtattgatggataaatgttttattatattttgaaattataatttagatattatttggtatgaattttttaatgtcgtgattgtcgggaagttatagttattagaaagtgagtttcgtaatattaaataattttaaatgaaattattgttttaatatttatattatttaagagtatttagagaatatgagagtgttttaatatatttgttacgatgtgggatggagtttttagaaattagagtatttaggatattagaagtttttaaaatagtttttgtatatgtttatttttatatatttttattaatgtggttttaagtttatatagatttatttataaatgttgtttgttgtataaagatgtatttttaagtttttattaatatttatttaaagataagggtaagtgaatataggaaattaatagtggaagggttttagtacgtgttattggtagtaggtgttattatgtatattataggaattggtttgtattaatattgttttagaaattttatattttttacgtgttggttttttgttgtttaggaataatttttaattagatgtgtttagttttgtttttatttaatgggtatttatgaggtaattattatgtgttagatatagtgttaagaataggagttttaaagaatgaatataatgttttaatttttgagatatttttgtttaggagtattagaatttagaatttagtttgttttgttagttttagttttttagtttggaggttttacggagtttgttttttagatatcgggaggtaaaaaaaaaaaaaaaaaaaaaattttttagcgtttgtgtgtgttattatttgttatattatagtgtggttttattttttattttttggaattatatttttaattgaaagattatttttttggttgggtacggtggtttatgtttgtaattttagtattttgggaggtcgaggtgggtagattatttgaggttaggagtttaagattagtttggttaatatggtgaaatttttgtttttattaaaaatataaagaatttagttgggtatggtggcgtacgtttgtagttttagttatttaggaggtaggaaaatagtttgaatttaggaggcggaagttgtagtgagtcgagattacgttatcgtattttagtttgggtaatagagtaagatttcgttttagaggacgggaggggaggggaggggaagaagaaagattatttttttgtgtatataagatttttgtttatataatggaaatatagtttttttaggttttaaagggttttttttttattttagtatatgggatttagttttttttaatagttgtatatattttattgtatatatttgttttaattgaggttattaattttttaaattgatttgggtgattaatttgatgatttgaattgattattatttaattgagtatatttagtgagtttagattatcgtttttgatttggaaggtgtgtaaataggtatgtatatatgtaaaaattattttgttatttttttttgttatataaattataaaaatgattataatgaggatatatggtaataaatggtattttatgtaatattatttattgtagtaaaaagatgtagagtatggttttagattttttgatttttttttttagtattttacgattttagtaaatttcgttttgatttcgtagtggtttatttatttttcggtttttttattttttttttgttgattttattttgttattttgtttttttgtttttaggggttttttattggtagttatataggttaatttttggtatttaaaagttatatttattaattttattttttatatattttcgtaggaatttttgtttttatggatggtagtttattatagtaggtttgggagttaggttttagtttatatttaagttttttgatttattaaatgtgtgagtttgagtaaatgatttaatttttcgaagttttagttttttaatttgtataatggtattgatggtaatattaggttaaattttgtgatattatttatatttaaattttgatttatagaagggtagtttattatggcgtaatttaattgtttttgttttttaggattggtgggtattgagtgagatagtatatgtgtgagagagagagattttttttttttattttgtttattagtgtaagaggaaaaggttaaattattattaatgagagaagtttagaaaaatggatatagtgatttttaattttaagaatgttagttgtagattagcgataatttgtttttatgaagaatgggaagggtttttttcgtttggttagttttttagtttttttaatatttttttgtttttattaggttataggtgggtgttttagattggtttttatttttttatttatgtttttagtttttagagatttttttttttttatggagtttttttttttttttttttattttttttaatttttatttttttgatttttagaaatttttttgtcgagttttcgtattatttattttgtttggtttaagttgttaatttgtttgtttagtttttatagtggagtaggtgtagaggtgatgaagtaagggtattttttatagttagttttaggattaaatttttgggaggttttttgattcggatagtgtttgttatggattagatgatgtttttttaaatatatatgttgagttttaatttttaacgtgatggtatttggagatgggattttcgtggggtaatgaagtttcgatgagggattagggatattagagagtttgtttttatttattttttgtttatgtgaggatatagtgagaaagtagttgtttgtaagttaggaagggagttttttttaaatttgattatgttggtattttgattttagatttttagtttttagaatattgagaaaataaatgtttgttgtttaagttatataagttatggggttgtatgatggtagttagtattgaggaaggtaatgtcgtaacggatatagtgaatttagtatgatttttcggttgtattttgttaatgggatttgggtattttttttttatttttgatgatgttataaaaggtttttttttatggttttggttgttttttttgttttgggaaagggtattttttttcgaaatgggaataggagtggtggaaatttatttaattttagatataaattgtttagaacggtgtttgatataaagtaaaggtttaataaattgtagtgtaagagggtgttagattttttttggttcggtttttatagggattaattttatgaagagttaaagtgtatgagatttatatgtgtagatttattttttggttagaggagagatattaaatgggtttaggagagaggtaggaggtgagagtttttttagttgcggattttagttttttttttatattttttaagttaagtttagtaagtgagtttaagagtgtttagaaatatgtttgttgagagtataggtgttaatttagttttgagaaagttagagttatttgtagatggggttttgatttttgttttggaaattgatagggtatttgggtggtggcgttaagagtttgtattgttttgggaatggtggtagttttagcgtgtgttgggtaaggtaaacgtatacgtgttttataggttagagttgggttatttagtagagagttagtgtggggtttttttttttaggggttttttggaaaggtaggggaacgttaggagagaggttgaaggtgtgtttttaggtattgggggttgagttataagtagtatttggaagaagatgtttttgttgaggttaagttaggagagaggtttttagtgggga

SEQ ID NO: 73 - DNA, 5690 bp, Artificial Sequence
  chemically treated genomic DNA (Homo sapiens)
  unsure (381, 706, 711, 1115, 1134, 1206, 1226, 1370, 1382, 1390, 2064)
  unsure (2069, 2295, 2337, 2352, 2354, 2361, 2555, 2671, 3057, 3171)
  unsure (3186, 3188, 3522, 3568, 3584, 3586, 3591, 3616, 3840, 3846)
  unsure (3912, 3999, 4319, 4577, 4600, 4626, 4629, 5299, 5306)
aaaatattttaaatttaatattttagtttaggagttggaagtttgtttttttattgagtattatttaatattttttgtttttgttatttaagggtaagttatgtgtgtgggttagggttgggcgtcgattaggataggttatggatatttgtgtattttgttagaagttcgtgttaggtttttataatggttaaacggtgttggttagaataatatgggttgattaaaggaaggtgtgtggggatgaatttgatagttaatggtattagtgtatattttaagaaaaagggagggggtaatttgagtgtttttaggattttttttaaaggcgtagattaaaataagttaagtagtcgttgggtaggttttagtagttagggntagtcgggttttgagtttagggttttttggagaatcgtttaatattgatttgtgagtaaggtgtttttttatcgatcgttattgattttttttttattttttaagataatgatcgtttgggatgaaattttttttttttgtattttagttaagaagtaaatttatttttagaatttaagaaagatttttaaatatttttaatttgaaaagttttaattttaagtaattttaaataaaattttttatgagtaattaaatatttaaaatgtgtttttttataaaagtgaattagtttagttttgtaggttgaaaatataataagganggatntcgggttgtagaaagtagagggttatttagatcgtgtttgagagacggggagaaagtagttgtttgttgtgtattagaggtttttagggatttcggtagtaatttcgtggcgggttatatttgggagttgatttgtttttagaattattagttaagttatatgagttaggagtttggttatttatttaaagtttataaatgtttattgaagcggaatttagaggaaaggtttagagggaagggttttttttttttttgattttgaaagagatttattgtagtttgaggggttggatggaaagatttagataaaaattataaaatagagaggataaaaggttataattagtgtttatggtatggtagaaagtttgtttgtttttgagtttagaaagttgtattgngaattttgtaatatatttngtttattttcgaggtttacgttgagttttagtgttttttttaggacgaggttggggttagtggagtattttngtcgtgtttttttttttaantttttgtacgttgattttggttttttgattgttttttttgttttcgtttaataaggtattttttatataggggttttgttatagaatgaattttgttttgttatttatttattttaaaattattattggttatttttttcgagnagtttagtttgnttagaagntatttttgtttatagggttagttttatattttttagttttttgggacgtggtttggtttgaggttttggttttaatgtttattatagtagttagattaggtgggcgtagttttttaatgttttttgtttgtttttgttttgttttttttttttgttttaataatttatttaggtttaaattgttaagtaagagtaattatttttaaaggttgttgtgagtaaggagtgtataagggaagttatttgacgtatttattatagtttttggtatggttagtattatttgtttatttgttattattgttagaattattattagaattgtttattatggttaggtatggtggtttataattgtttattatggttaggtatggtggtttatatttgttattttagtattttggaaggttaaggtagatagattatttgagtttaggaatttaaagtttgggtaatatagtaagattttgtgtttataaaaaaatttaaaaattagatgggtatggtagtatatgtttgtagttttagttattggggaggttaaggtaggaggattgttttagtttagaaggttaagtttgtagtgagttgtgattgtattattgtattgtagtttgggtaatagagtgagatttagttttaaaaaaaaaaatgaatgaattgtttaatantattntattattttttaagattcgttttttttaggaggttttattttatcgtttatattagtgttttttaggttgggttaggtttgggttttaggttttttggtatttaagtttgttttttattttaggattcgttatattatattgtaatgtatatatttgttatgttttattgataaatttatattttatttttgttttttatattattattttaatagttattattgntattgatgtttaaatttaatgaataaatgaatatatttattnttatagtgggtatantnagatgtntagtttattgttaagtttttttttgaagatatttgatgatgatgttaatttagtagtttgtttttataggtttggaagttttgattattataatagttattttttatttaatttgtgttttttttgttatagtttttatttatattatttgtttttaatttaaagtagagtttatagttgattgttattattantttatattatttggttgtattggttttaaggttttttatttattttagaatattgattgtttcgttgtagtttgattttaataatttttattaatttgtttcgaaattaggagggntttgattttttttataaataatgttttatgtatatgtttttagaaaagaggttggggtttgaattttttagatatggtttagttgagttttttggtttcgtttatttttagtttattagggatagtgatatgggttaaaattgttttaaaatatttttgacgagtatttttttgttatttcgtttttttggggtggaatgagtattgtagtagtttcgtgtagagaaggatatgagtagtttaatattttttggaatttttgataattttttgacgatgtttgtttattatttttattttttttttagttaagtgattttatttttttaatttttttttaaaagattattaatttagtaagtggaaggaaatgtttataatattgngagaaggtaaagaatgggttgattttattttaaatggaggaagatgtagtaggatttgtgggtggggttattttttaggtgaagggaggggttaaatatgaagatttttatttngtatgtaaattttangntgatgtatattgtttagagaaaacgtttaattttttgattaattatgaatttgttttgaaaacgttgatttttattaggtgataaattagaaattttagggtattttaggagtattttttaggaataaattttaaggagtgatatttaaattaatgaaaatgtgttttttttttttttttgaaatggtagcgataatattgaaaattaagaacggtaatgataggagatttttaaaagtaaagtatttttgggtaatataatcgtaaaagataatttatagaagtttagttattttaataatttatatagtattttcgtgtttggtaggttgtnaattttgttttgttttggtaaatgagttagttagaagttagaaagnaaaagttgatttttantnatttntgtagttttataaagttaattaatntaaattaataaggattagttaatgtttgtatttttttttttttgtttttttgagtattataaatttaaagtagttgtgtgtttttttttatttaatttttggtttattagttaaagtatatgtagttagtaaattcggtggttgagatttggtttttttaagtttaatttagaggtttttagaggtaaaaaaaatttgtgttaattaaataagttaattgaggntcgggntgtgatggtttatatttgttattttagtattttgggaggttgaggttatagttttgtgaggtgggnaggattgtttgagtttaggagtttaagattagtttggataatatatgagatattgtttttataaaaaagtagaaaaattaattgggntgtgttggtatatatttgtagttttaattattttggaggttgaagtaggaagattattcgagtttaggagtttaatgttgtggtgagttacgatgatgttattgtattttagtttggtgatatagtaagattttgattttaaaaaggtaataagttaattaaaacgttatgttagtttttattttagagaaagaggtttgttttttatgatgttatggatatttatgaattgtgtatatgtttttatatattttttttttatttatgatgagagtgaaataattttatttatttatttaatgaattttaattagaatttnttatgtgtttgttttagttagatgttgggaaataatatagtgaataagagatatcgggttggaggaagaagtagaaatagttatagatatttattagatatttatttttattttaattttcgtttttattttgagtttagttttgagtatttttttgttttatcgggaatttatatagggtagggtaggaagatgaaggaggaaatagttttttttaattgaaaggtttaattataaaagattttgtataattaagtnttagagtgagggattttttattnatagtcggaagttggatagtttgaantanttaaggttttcgttaatattttttcgttagtttcgtatttattgtattgtattttatttattattttagttgggttcgcgtttcgtttatttcgcggggattggttgcgaacgcggaagaattaagtttacgtttcgcgttcgcgtttattaatggaagcgttcgttcgttttgatagacgtgttatttttcgttaatggggacgaagggaagttttagcgtgtggtttcggcgagtgcggataaaagtcgtttcgtcgggttcgggttttattttgagtcgagttcggtgttaagcgtagttagtttagtaggcggtagcggcggtttgagttttagggtagttagttttttttcggtttcgttttttttcgcggttagtatgaaagtttttagtttcgtgaggttcgttaggaaaaatagtttgtcggattatagtttgggtatttttcggagtaaaatttttgtggacgattcgatgagtttgttatataatatgaacgattgttattttaagtttaaggagttggtgtttagtattttttagaataagaaggtgagtaagatggaaattttgtagtacgttatcgattatattttggatttgtagatcgttttggattcgtattttattattgttagtttgtattattagagattcgggtagaatntaggcgntttaggacgtcgttgattatttttaatacggatattagtattttgtttttgtaggtaagatttgtttcggggttttcgtttcgtcgtcgtatattttcgcggtcgtttgggttgttattaggagattcgtagtttagacggtgattttcgtatgagttatttaattttattttttttagaatttgttgtagattgagttgtgcgtgaaattgttagtaagttttgatatgttaatgcgtttgtttttaaatttgaattgttattataaacgtgtttaatggaatttgttggtttgtggattataaaaaaaaaaaaaaaaaaaaaaaaattttttttatttaatattgttttaatttcgtattttttattttttttttttttagg

SEQ ID NO: 74 - DNA, 5690 bp, Artificial Sequence
  chemically treated genomic DNA (Homo sapiens)
  unsure (385, 392, 1062, 1065, 1091, 1114, 1372, 1692, 1779, 1845)
  unsure (1851, 2075, 2100, 2105, 2107, 2123, 2169, 2503, 2505, 2520)
  unsure (2634, 3020, 3136, 3330, 3337, 3339, 3354, 3396, 3622, 3627)
  unsure (4301, 4309, 4321, 4465, 4485, 4557, 4576, 4980, 4985, 5310)
tttggaaagaaagaggataaagagtacgaggttaagataatgttaagtagaaagggtttttttttttttttttttttttttgtagtttatagattagtaagttttattaaatacgtttatggtaataatttagatttaaagatagacgtattaatatgttagaatttattagtaattttacgtatagtttaatttatagtagattttgaagaaaataaagttaaatagtttatacgaaagttatcgtttgggttacggattttttagtgatagtttagacgatcgcgggagtgtgcggcggcggggcggggatttcggagtaggttttatttgtaaggataggatgttgatattcgtgttgagggtggttagcggcgttttggancgtttgngttttgttcgggtttttggtgatgtaggttgataatagtgggatgcgagtttagggcgatttgtaggtttaagatgtagtcgatgacgtgttgtaggatttttattttgtttatttttttgttttgggggatgttgggtattagttttttgagtttggagtagtagtcgtttatgttgtatagtaggtttatcgggtcgtttataggggttttgtttcgggagatgtttaggttgtggttcgataggttgttttttttaacggattttacgggattgaaggtttttatgttgatcgcgagggaaggcgagatcgggagggagttggttgttttgaagtttaggtcgtcgttgtcgtttgttgagttagttgcgtttggtatcgggttcggtttagaatgaagttcgagttcggcggggcggtttttattcgtattcgtcggggttatacgttggagttttttttcgtttttattggcggaaggtggtacgtttattaagacgagcgggcgtttttattggtgggcgcgggcgcggggcgtgggtttggttttttcgcgttcgtagttaattttcgcggggtgggcggggcgcgagtttagttggggtggtaaatagagtatagtatagtaagtgcggggttggcgggggggtgttggcggggattttggntgntttaagttatttaattttcgattgtnggtaggaaattttttattttaanatttaattatataaagttttttgtggttgagttttttagttagaagaggttgtttttttttttatttttttattttgttttatgtggattttcggtgaggtaggaagatgtttagggttgagtttagggtgggggcgggggttggggtgggggtgaatatttggtaagtgtttgtggttatttttgtttttttttttagttcgatgttttttgtttattgtattgttttttagtatttagttgggataagtatatagnaagttttagttaaaatttattgaatgaataaatgaagttattttatttttattataaatgaaaggaaaatgtgtaaagatatatatataatttataggtatttatgatattataagaaataggtttttttttttggagtgaaggttgatatgacgttttgattgatttattatttttttagagttagggttttgttgtgttattaggttagagtgtagtggtattatcgtagtttattatagtattgaatttttgggttcgagtgatttttttgttttagtttttagaatagttgggattataggtatgtgttaatatantttagttaatttttttatttttttgtagagatagtgttttatatgttgtttaggttggttttgaatttttgggtttaagtaattttntttattttataaagttgtaattttagttttttaaagtgttgggatgataggtatgagttattatanttcggnttttaattgatttatttaattggtataaattttttttatttttagaagtttttaagttgggtttgagaaagttaggttttagttatcgggtttgttgattatatatgttttggttaataggttaaaggttgagtggggagaagtatatagttgttttgaatttgtggtgtttaaaaaagtagggagagaaaagtataaatattagttagtttttgttgatttangttggttggttttgtaagattgtangggtngntagaagttagtttttnttttttggtttttgattgatttatttgttaaagtaagatagaattngtaatttgttaggtacgaaggtattgtgtgaattgttggaatggttgagtttttatagattattttttgcggttgtattgtttaaaggtattttgtttttggaaattttttattattgtcgtttttaatttttagtattatcgttgttattttaaaagggagggagaaatatatttttattagtttgaatgttattttttgaagtttgtttttggggagtgtttttaggatgttttgaaatttttgatttattatttaatgaaaattagcgtttttagagtaagtttatgattgattaagaagttgagcgttttttttgggtagtatgtattantntgaaatttatatgtnaaatgaaaatttttatgtttagtttttttttttatttagaaaataattttatttataaattttgttgtatttttttttatttaagatggaattagtttattttttgtttttttntaatgttgtgagtatttttttttatttgttgagttaatgattttttggagaaaaattaaggaaatagagttatttaattgagggagaggtgggggtgatggataaatatcgttaaggggttattaaggattttaaaaggtattaggttgtttatgtttttttttgtacgaaattgttgtagtatttattttattttagaaaagcgaagtggtaagggagtgttcgttaggagtgttttgaagtagttttggtttatgttattgtttttaatagattgaaagtgaacgaagttaagaggtttagttgaattatgtttaggaaatttagattttagttttttttttgaaagtatatgtatgagatattatttgtagagaaaattaaantttttttgatttcggaataagttggtgggaattgttagggttaagttgtagcgagatagttagtgttttgaggtagatggagagttttagagttagtgtaattaggtggtgtggantggtggtgatagttaattatgggttttgttttaggttgaaggtagatgatatgagtgaagattgtagtagagaggatataggttggataaagagtaattattgtgataattagagtttttaagtttgtgggaataggttgttgagttaatattattattagatatttttaagaaaaggtttgatagtagattanatatttngntgtgtttattatggngatagatgtgtttatttatttattaaatttgaatattaatgntagtggtaattattaggatagtagtatgggaaataaagataaaatataaatttgttagtgaggtatgataaatatatatattgtagtataatatggcgagttttaagataagaggtaagtttgggtgttaggaagtttggggtttaggtttaatttaatttggggagtattggtatgggcgatgggataagattttttggggaagacgagttttaggagatggtanggtgntgttgggtaatttatttatttttttttttgagattgggttttattttgttgtttaggttatagtgtagtggtgtaattataatttattgtaggtttgattttttgggttaaagtaatttttttgttttagtttttttaatagttggggttataggtatgtgttgttatgtttatttaatttttaaatttttttgtagatatagggttttgttatgttgtttaggttttgagtttttgggtttaagtgatttgtttgttttggttttttaaaatgttgggataataagtgtgagttattatgtttggttatgatgggtaattgtgagttattatgtttggttatgatgggtaattttaataataattttaatagtgatgataggtaagtagataatattggttatgttagggattgtggtaaatgcgttagatggttttttttatgtattttttatttataatagtttttggaggtgattgtttttatttggtagtttgagtttaggtaggttgttgaagtagagagaaagggtaaggtaggaataggtagggggtattgaagagttgcgtttatttggtttggttgttatgatgagtattaaggttaggattttaggttaggttacgttttaaaggattgaggagtgtggagttgattttgtgggtaggagtgntttttgantaggttaagttnttcgaagggagtgattagtggtgattttggagtaggtgggtaataaggtaggatttattttgtagtaagatttttgtgtgaagagtattttgttgggcgggaataggaggaatagttagggaattagaattagcgtgtagaagnttgggagggaggatacggtnagggtgttttattagttttaatttcgttttgaggaagatattgaggtttagcgtagatttcggaaataagtnaggtatgttgtaggatttntagtgtagttttttggatttagaggtaagtaggttttttattatgttatagatattgattgtgattttttgttttttttgttttgtgatttttgtttaaatttttttatttagttttttaggttataatgggttttttttagggttagagaagagagaaatttttttttttgaattttttttttaagtttcgttttagtaggtatttgtgggttttgaatggataattaggtttttggtttatgtggtttagttggtggttttgaaaataaattagtttttaagtgtggttcgttacggggttgttgtcggggtttttagaggtttttggtgtatagtagatagttgtttttttttcgttttttagatacggtttaggtggttttttgttttttgtaattcggnatttntttttgttgtatttttagtttgtagaattgagttgatttatttttatggaaaaatatattttaaatatttagttgtttatggagagttttgtttaaaattatttgaaattggaattttttaaattggagatgtttgaaaattttttttaaattttgaaaataagtttgttttttggttaggatgtaagaggaagaaattttattttagacgattattgttttgaaaagtgaagaaggagttagtagcgatcgatgagagggtattttgtttataggttaatgttgggcggttttttaggaggttttgggtttagggttcggttgnttttgattgttgggatttgtttagcggttatttggtttgttttggtttgcgtttttaaagaaagttttgggagtatttaagttgtttttttttttttttttgaaatgtatattaatgttattaattattagatttatttttatatatttttttttgattagtttatgttattttggttagtatcgtttggttattgtagaggtttagtacgagtttttggtaggatgtataggtatttatagtttgttttggtcggcgtttagttttggtttatatatatggtttgtttttaggtaatagagataaagggtgttgagtagtatttagtgagaagataagtttttagtttttgaattgaagtattaagtttaaaatgtttt

SEQ ID NO: 75 - DNA, 6053 bp, Artificial Sequence
  chemically treated genomic DNA (Homo sapiens)
atttcggttttttataatttttattttttaggtttaagtaatttttttgttttagttttttaagtagttgggattataggcgttcgttattacgtttggttaatttttttatttttagtagagaaggggttttattacgttggttaggttggtttcgaatttttgattttacgtgatttgtttgttttggttttttaaagtgttaggattataggtgttagttattttgtttagttttaatatttttaaatattgtttaaaatatttagatattataggtaatttttagtaaaaatgataaatattaaatttattaagtaataaatttacgatttagattggtgtttatttgaagttttagaaggattatatttttttggaataaaaagaatgaagtgagtaattaaaggatggttatttagattgtaaaatgtttatgtaaaatatttttaaataaatgtaaattaaataatgaaatataattttttaattattaaattggtaatatttttaagtttaataatatgagatattggtgattataggggaaataagtatgtgtatatgttgttggtaggattataaatttatacgatttttttgaagggtaatttggtaatatttttttagtattgtaattatattgttaagtgatttaataattttaatgaaaggaatttatattataggtataattttgaggaatatacgaatatataagtatatatttgggaatgtttattatagtttggtttgtaatggtaaaaattggaaaaaaatgtttatcgataggggattagtgaaataaattaagatatttttatattataatataattttaaggttaaataatgagttagagttttatgttgatatagaaatagttttaaaataaagtgaaaaatataaataatgagtagaggtagtttatgattttatttgtgaatagtttttagaaaagagaatgagagaagagtagaaggatgaagtatttttaaaagatgacgattagggaaaataagttgagaaaaaaaaggaaataaaaagaagagagaaaatgtaaattttttggtttatagttagttattttttgtattttaatattttttgtataattaataatgttaaattttttttttttgtaagttacggtttttaaggtggaattaagaaattgatagatagataaagaaagtataatattaaaagaggtatttttttagttttatttttgtattaagattattgaagataaattaaggattaaaaagttttatatttttatttttaaaatattttatgattagtataaatttattttaattaagaagttattgtttttggtaaaaagaatatttgttttgttatagaggtatacggtaaagtttagatatttgtattggtttttgattttattatttttaatttatataattataattttttgggattataagattattttttttagaatttttttgataggttaagagagtaagggtaaaggtgagggtatagtaggtagtagattttttatttagattagaaaattaaggaagaaaaaatagggattgtataaatataagaagaaaagggttatggttagttaaataaaatgattttttttgtgcggagttttattattatagagttaagtatttttatgaagtaagttaaaagaaagaagaataatttttgagtttacgaggtgtttattaaattgtatttatgaattattagtttaaatgtttaataaaagtagtgtattttgatttttaatgatttatagtttttgaattttttaaagtataataattttttagtttaatttattattatttattatagagattgaagtggtggggtgggtaagggagagagagatggagagagggtgagtgttgttaagtattttgaggagatagggatgaggggataaatatagtgtgtttagataatggaaatatagtgaaaggtttatgcgtttttgtttatatattttatttgatttatgttttatagtttggaaataattttgatagtttaattttataattaggagagatggagagagattatttttattttatagatgagaaaattgagttttagagagggatagtaatttgttaagattatatagtaagtggaaaaagtataataagaatttaggtttttagatttaaattttgtgttttttttttatttttttttagttttattttttttattgttaagggtagggaagttgttagggatagaaggttggaatgggattttaggataagattgagtagagatttgaatgtggggttgaatgtaggggagtttagaaggtttttgggtggtttcgagtgttagggagattattcgagttagggagattattttagtgtagaggtattattttttttatttatttgggtaaggtaaggaggtttaaggggaggttggggtaataatagtttggttttggattatgaaattataattcgatatagggaaggaagatttagaagattaggtgggaaagaaaagggttggtttcgaattaataagagtttataggagtttatgtgttttgttggggattatagaatgttttatattttagaatgtgatttattaaaagttattataataaaaatgttgggtatttaaatatggtttagttttattttattgatttggagtatagtatttttagttataataagtatatttttataggttttaaaataaagtaagaatttttaaggttaaaaaaaaaaaaaaggttaaagatgtaaatgtaaatgatagttttattggtaaattttaattggggaattttttttaagtaaaaaattattgatatgtataaagatttagttaatagtgttgtttgtattacgaaaaaatggaaataatttaattgttttataataggggattaattgggtaaatttttatttatttttgtgaaagaataatgtatatttattataaatgatattgtataagtatattttatgatatggaaagatgtttattatggttaaatatatatatgtatatacgggtatatttatatttgtatttgtgaattaaaattaagtttttgttttaaagtattttttatagtgttttgttgtttttatagggttattgtggttaatttattagattataaagatgtaaattttttttttttaattttattttgaattttttagtggatgtgttaggtttttaggggaaggataagtatttatttgttgtattaagaaaggattttacgatttaggggttatttgtttttttttatttttgtttagaaggttttggtttttgtagtaagtttttatttttatttgttatttaaagtattttaaaatttatttttttattttagagtgttattgttttttattttgtttaatatttagttaggttttttttttagttttttttattttttttttttttttagtttttgatttatttttatttggtagatagttttgtttatttttgttggtattttgggaattaggtttggtattggttatagtatttagattgtaatgcgttagaatgggattaatttatgtattttttttacgggagggaggtagagtgattggtaagtcgaatgttgtatgggtgtgtttatttatagtttgtaaaatggggtgttgttttggagggagagttggggtgaaggaaatgatacgtttgggagagtaatttatttttgtaggagttttagggagatgaaggaagaagttttttgggttagagttttggatggaaaatgaatatttagttaagtttttaggattatacgtggggcggggattagttgtgcgcgagagttaagtaggggttttattaaggagtatgggatttgggttttttaattttttggttagttttatggcgttgattagttttgagttaatttttttatgttgtttagaatttttttgggttaagttttggggatttagagatgatagtaatgtttttattgcggaatttttatacgcgggttatagggaggttttggaggcggtttgaggtaagagtgttaggagggattagagttagtttatttttatttttatttagtcgtttgggtttttttgaattttttttttttttttgttttttaaagttagttagggggagttttagggaggtagatcgaaaaggggtggggtgttattttggttattattagattttgtaacggcgattttgaaaattatttagcgtttgttgttcgagtggagtatagtgttttataatttttttttattatagtaaattattaaggtagggttattattattttatggttgaaaaatagaggttttgcgttttttgggggttgtgttagtagcggttaagttgggattttttttggtttagtagttttagatagtatacggggtagggtaggttttttgttttttttatttttttagggtaggtgagtgatttggagggagggggaagtcggagtaggggtggattgggagcgttcggggcgggttcgcggtggtttcggggcggtggcgttcggtcggagagggtggggcggagtagtcgttttgtatttttttttcgtcgttagttttataatagtttgattttttcgaaatgacggtacgtagtcggttaatgggcgttcgcgcggttgttcgggggcggggtcggttagggttggggaatttcgttaagtgtttggattgttcggtggcgtcgttgttttggtagagttcgttattttttagtcgaggtaagacgtgcgttcgagtttcgtcgaatcgaggttattcggagtcgtgtttagtttacgtcggtcgtgttcggcggttttaagaattcggtaatttttgttttttttttttttttattcggagtcgcgtttcgcgcgtttttattgtagtttttgcgtcgtcgggattttcgcgcgcgatcgtcgaatcgtttttgtagtagaggtgagtacgtttttgaggcgcggggtatcggcggcgtcgaataaaaggcgcgcggggtattaggaagtggggggtcgaaagttttaggttggagattcgtcggcgcgcggcgttgttcgggttttcgcgcgggtttcggggggcgtcggaggagttgcgagtcgcgggtcgcggcgcggggagggcgggacgcggcgtggatcgtttattcggacgaggttgtcggcgttcggtagtttttgtagatttgcgtgcgcgtagtcgttaggggtttgtaggtggttcgttatgttcgtttcgcgtatttatacgtcgtgtcggggatcgagtgttagtttacgcgtgggcgtttagtgttttcggttttcggcggttttagtttcgcgtttaggcgataggttttgggttttttgtgttggtggtaagggttggtttattgtttaggtggttggagggaatcgtgatttacggagattgcgggaagaggcgttataggtgttttttgggttatttttttagaggaggggaaatcgggtcggaagggttagcgttttggttttagcgttgtgggcgttgtggttgttaggaaggcgtagaatggatttaggggggcgggagggggttgtttagggtgacggttagttttttgttagttagtggttataatttaagttaagggaatttttttttggtattaagtaaaagaagtttttttttttttaaaggatttgaattttgagcgaaaagttttgaaattagggtatttgtgtattttgtttttttttttgtatatgaattttgaagttattatttgtatgtttgttttttttagagattggttgggaggggttgaaggaaggggtaaaagtatttttgtttaagatgttgaaaaaatttggagagtagttttattttagcgtagttttttttcgtattgagtgtagtatttagtagttggttgaggtgaggggagggtaattaagtgatttcgggtggggtaggttattgtttaggtattgtttaatagattttagattggagtttttgtgttttttttatagt

SEQ ID NO: 76 - DNA, 6053 bp, Artificial Sequence
  chemically treated genomic DNA (Homo sapiens)
gttgtaaagagaatatagaggttttagtttggaatttgttgaatagtatttgggtagtgatttgttttattcgaggttatttagttattttttttttattttagttagttgttaggtattatatttagtgcggaggggagttgcgttggaataaaattgttttttaaatttttttagtattttaggtaaaaatgtttttgtttttttttttagttttttttagttagtttttggaggagataggtatgtaagtgatggttttaggatttatatgtaggaaaagagataaaatgtatagatattttaattttagaatttttcgtttaaaatttaaattttttgggaagggagggattttttttgtttgatgttaagaagaaatttttttgatttgagttgtaattattagttagtaaagggttagtcgttattttgaatagttttttttcgtttttttgaatttattttacgtttttttgatagttatagcgtttataacgttaagattaggacgttaattttttcggttcggtttttttttttttggagaagtggtttaaggaatatttgtggcgttttttttcgtagttttcgtaggttacgattttttttagttatttgggtagtaagttagtttttgttattagtatagggagtttaaaatttgtcgtttgggcgcggagttgggatcgtcgaaagtcgggagtattgggcgtttacgcgtgggttgatattcggttttcggtacggcgtgtggatgcgcgggacgaatatagcgggttatttataggtttttggcggttgcgcgtacgtagatttgtaaaagttgtcgggcgtcggtagtttcgttcgggtgggcggtttacgtcgcgtttcgtttttttcgcgtcgcggttcgcggttcgtagttttttcggcgtttttcggagttcgcgcggaggttcgggtaacgtcgcgcgtcggcgagtttttagtttggagttttcgattttttattttttggtgtttcgcgcgttttttattcgacgtcgtcggtgtttcgcgttttaaaggcgtatttatttttgttgtaggagcgattcggcggtcgcgcgcgagggtttcggcgacgtaggggttgtagtgagggcgcgcggagcgcgatttcgagtggaagagggaagaaggtagaggttgtcgggtttttaaggtcgtcgggtacggtcggcgtggattgggtacggtttcgggtggtttcggttcggcggggttcgggcgtacgttttgtttcgattaaggagtggcgagttttgttagggtagcggcgttatcgagtaatttaaatatttagcgggattttttagttttggtcggtttcgttttcggatagtcgcgcgggcgtttattggtcggttgcgtgtcgttatttcggggaaattaggttgttgtagagttagcggcgaaggggaagtatagggcggttgtttcgttttatttttttcggtcgggcgttatcgtttcggggttatcgcgggttcgtttcgagcgtttttaatttatttttgtttcggtttttttttttttttaggttatttatttgttttggggaagtgaagaaggtagaaagtttattttgtttcgtgtgttgtttggggttgttggattaggggaaattttaatttggtcgttgttggtatagtttttaagggacgtaggatttttgttttttaattataaaataatagtagttttattttgatggtttgttgtgatgggaagagattgtaaagtattatgttttattcgggtaatagacgttgagtagtttttaaggtcgtcgttgtagggtttaatagtgattaggatgatattttattttttttcggtttgtttttttgggattttttttggttggttttagggaatagaggaggagaaggggtttagagaagtttagacggttgagtgagggtaggggtgggttagttttgattttttttagtatttttgttttaggtcgtttttagagtttttttgtggttcgcgtatgggagtttcgtaatggaagtattgttgttatttttgagtttttagggtttggtttagagaggttttgggtagtatggaggaattagtttagggttgattaacgttatggggttagttaaagggttggggagtttaggttttatgttttttggtaaggtttttatttaattttcgcgtataattagttttcgttttacgtatagttttagagatttgattgggtgtttattttttatttaaaattttggtttaggaggtttttttttttatttttttaaagtttttgtagaagtaagttatttttttaggcgtgttattttttttattttagttttttttttagggtagtattttattttgtaggttataaatagatatatttatgtaatattcgatttgttagttattttatttttttttcgtagaggaaatgtatgggttaattttattttggcgtattgtaatttgagtgttgtgattaatgttaaatttggtttttaggatattagtaggaatgggtaaaattgtttattagatagaggtgggttaggagttaggagaggaaaggaggtaggagaaattgaggaaggaatttaattgagtgttaagtaaagtggagggtaatgatattttggaatggaaaggtgggttttggggtattttaagtgataaatggaagtggggatttgttatagggattaagattttttgagtaagaataagagaaaataagtgatttttgagtcgtgggatttttttttggtatagtaaatagatgtttgttttttttttgagaatttgatatatttattggaaaatttaggatgagattagggaaaggaagtttgtatttttgtggtttgataagttgattatagtgattttgtgaaggtaataggatattataaaaaatgttttaaaataaaaatttaattttaatttatagatataggtataaatatattcgtatatgtatatgtatatttagttataatgagtatttttttatgttatgaaatgtatttatgtaatgttatttgtaataggtatatattatttttttataaggataaataaaaatttatttaattaattttttattgtaggatagttaggttatttttattttttcgtaatataaataatattattagttaaatttttgtgtatattaataattttttgtttaggagaaattttttagttaggatttattaatgaaattgttatttatatttatatttttgattttttttttttttttaattttagggatttttattttattttgaagtttgtaagaatatgtttattatgattaggggtgttatattttaaattagtgaaataaagttaagttatgtttaagtatttaatatttttattgtaatggtttttgatgaattatattttaagatgtagaatattttgtgatttttagtagaatatataggtttttgtaggtttttattaattcggagttagttttttttttttttatttggttttttgggttttttttttttgtatcgggttgtgattttatagtttaggattagattattgttgttttaatttttttttgggtttttttgttttgtttaggtagatggggaagatggtgtttttgtattggaatgatttttttaattcggatgatttttttaatattcggggttatttaggagttttttgagtttttttatatttagttttatatttaaatttttgtttagttttgttttggggttttattttaattttttgtttttgatagtttttttatttttggtagtagggaagatgaaattaaagggggatgaaaagagaatataggatttgagtttgaaagtttgggtttttattgtgttttttttatttgttatgtgattttagtaagttattgtttttttttggggtttagtttttttatttgtaaaatagagataatttttttttattttttttaattgtaaaattagattattaaaattatttttaaattgtaagatataagttaaatgaaatgtatgaataggaacgtatgaattttttattgtatttttattatttgaatatattgtgtttgtttttttatttttgtttttttaggatatttggtaatatttattttttttttattttttttttttttgtttattttattattttaatttttgtaatgggtagtagtgggttgagttgaaaaattgttatgttttaaaaaatttaagaattgtaagttattggagattaaaatatattatttttattaagtatttgaattaatagtttatgaatataatttgatgggtatttcgtaaatttaagagttattttttttttttttaatttattttatgaagatatttggttttatgatgataaaatttcgtataagaagggttattttatttagttgattatggtttttttttttttatatttgtatagtttttgtttttttttttttggttttttgatttgggtagaaaatttgttgtttgttatatttttatttttatttttatttttttggtttgttagaagaattttagggaagatagttttatggttttaagagattgtggttgtgtagattgagagtggtaagattaggaattaatgtaaatgtttgggttttatcgtatatttttgtaataaaataggtattttttttgttaagagtagtaattttttaattaaggtagatttgtattagttataaggtattttggaaatgaaaatgtggaattttttgatttttagtttatttttagtgattttaatgtagggataaaattagaagaatattttttttgatgttatgttttttttatttgtttattaattttttagttttattttaaaggtcgtagtttataggaaaaagggatttgatattgttaattatgtagaaaatgttaaaatgtagaaaatagttaattataggttagagaatttatatttttttttttttttttgttttttttttttttttagtttgttttttttagtcgttattttttaagaatgttttatttttttattttttttttatttttttttttgaaagttgtttataaatgggattataagttgtttttatttattatttgtgttttttattttgttttagagttatttttatattagtataaagttttagtttattgtttaattttaaaattatgttataatatgaaaatattttaatttattttattagttttttatcgatggatatttttttttagtttttgttattataaattaggttataataaatatttttaagtgtgtgtttgtgtgttcgtgtattttttaagattatatttgtaatgtaaattttttttattggaattattaagttatttagtaatataattatagtattgagaaggtattattagattgttttttaagaagatcgtatgagtttatagttttattagtaatatatgtatatgtttattttttttgtagttattagtattttatattattgggtttgaaggtgttattagtttggtggttgaagaattatattttattgtttgatttatatttatttgagggtattttatatagatattttatagtttaaatagttattttttagttgtttattttattttttttgttttagaaagatataatttttttaaaattttaaatgggtattagtttaaatcgtaagtttattgtttaatgagtttaatatttattatttttgttaaaagttatttgtaatatttaggtattttgaatagtatttagaaatattgaggttgggtagggtggttgatatttgtaattttagtattttgggaggttaaggtaggtagattacgtgaggttaggagttcgagattagtttggttaacgtggtgaaattttttttttattaaaaataaaaaaattagttaggcgtggtggcgagcgtttgtaattttagttatttggaaggttgaggtaggagaattatttgaatttgggaggtggaggttgtagggagtcgagat

SEQ ID NO: 77 - DNA, 6071 bp, Artificial Sequence
  chemically treated genomic DNA (Homo sapiens)
  unsure (3292, 3454)
tagtttgtaggtggttgtttttttgttgtgtgtttatatggttattcgtttgtgtgtgtatacgtgtagtgtttgtgtttgtgttttagttttttttttttataaggatattagttaaattggattagggtttatttttttgatttttttttattttaatttttattttaaaaggtttatttttaaatattattatattttaaggtattgggggttagagttttaatatgtgagttttagggagatatagttgagtttataatattttttatagaataattaagtttgagatatgttatatgttatattttttttttggaaatttgtaaggtatatatgtatatgaatgattgtgtaaagttttggaaaatatttagtatttattttttatattttttttgtttgatttattatttattgataattttttattggttttttttatgtattggttgagtgtattgagttgtcgtatggaaatatgatttgtcggttgtcgttggtagttaggaagggaaggtggatatggagagagtaagtaaaagttggagttttaaggagatgaagtggaatttagggttgtattttattagagcgtatgttggttttttattatttttaggttttcggttttgaagatgttcggggagttgttttggagggttacgtggagagaatgggattggtaagtgggtaagagggttggtttttgttggatggaattgcgttttttattttttttaaggggatttttggattgttaggggtttggtatgttttgttttatttatatttgttggttagggtgagtggttttttatttggtttaattttgttgttttttttgttgtgttttttgtgggtgaggaaaagagtagagttgcggatgttattggagcgtggttaggttgggtgaggatttatatagaaaagtgtgggtaggcgtggtgggtgggggcgggggataaggtatgggttttgggtagttagttagtgttttcgttacgttttggttttaggtgtttagtattagtcgtgtgtatattttatttcgtaggtttttttcggttgttggtttattttttgtatgttatttttatttttttgattttttgtttagtttagttattttagtttcgagtttcgtttttttttttgaatataattagaattttttttgttggttttggatttttatgttgaataatttttatggtgttggtttttttttaattttttgaattaaattttagatttattgtaagtttttagttaagtgaagattttcggtggtttttttgttattttggtattcgaggaagtagatgtttttttttttttttgtagtgtttttattatgaattatttttaggtttttttaataggattagttagttttttattttagttgtgttgtaattttggtatttttgtagtttggtgaagatgacggtgttttaatgaagcgtatatttttatagtaattggtttggtatatgtaaataggaatagtagtttttttttttgtaaggtacggtgtagattgttttttacgtattatttttgtttttcgtattattttttttaattcgaaagatagagtatattgttttaattttattaagtagaaaattggtttttagagagtagttttgtttagttagggtatgttagagtattgtttgggatttatattttttgattttagggttaaggtatttttgggtttttatacgggtattaatagagatatattttatgtttaaattagttttttggttaagtattatttttagttttttagaatttattgtatttttttttaaattttaatttaaaagttttatatagtatggtggttcgtgtttataattttagtgggaggttaaagtggggggattgtttgaagttaggaatttgagattagtttgggtaataaagcgagattttatgtgtaaaaaataaaataaatgaaaaattagttgggcgtgaaggtgtatttttgtagttttagttattttaaagtttaaggcgggagaattatttaagtttaggagttcgaggttgtaataagttatgattgtatcgtagtattttagtttgggtgatagagagagattttgtttttaaaaaataaaagaaataaaaaattagttgagtagggttgtatatatttgtagttttagttttttgggaggttgaggtaggagaattgtttgagtttaggaggttaaggttgtagtgagttgtggtcgtattattgtattttagtttgggcgatagagtaagattttgttttaaaaaaaaaaaaaaaaaagttttttagtaggttttgttataatattttttttggtatttattgtatttggtaattttgaaataatttttatagtgaattttatttattgaattgttttgggaaacgtatattttttaaattaaagttgttatattagtgtgagagttatgtttatttaggaggtttggacgtattttttttttggtttggttttgatttgttatttttgcggtttttttttttagaatttttttttttcgtttttgtttttatagtcggtttttattttatattttatagaatgtatttgtattttaagtaatatttttttaaattttatatatgttttttttttttatatatatttaaaagtaatatatttaaggatgtgttaatttaattaaatatttttgagatatttataaaattatgggagttgtttatggtggtattttttttttttattttgagatggagtttagttttgttatagtggtgtgatttcggtttattgtaatttttgttttttgggtttaggtgatttttttattttagtttttcgagtagttgggattataggcgtttattattatgtttggttaatttttgtatttttagtagagatgggtttttattatgttggttaggttggtttggagtttttgattttaggtgatttatttgttttggtttttaaaagcgttgggattataggtatgagtcgttatatttagttttgtggtgtattttttaagtagaattttgtgtttatgttatcgagaaagggttagtaaaatattttgtatttttttaagatttagtttaaaaagcgttgtaaaaatatttttttattagatttttaaataatttttaagaggattaggttggttggtattttatagatgaggaaataggtttagagtgggtgggtgatttggagtattttgtattgagtgggaggggaagttaatttttttgttttagtttttttanagtagttgggattagaggttatgcgtttttaaatttggttaattttgtatttttagtagagatggagtttttttttgttggttaggttggttttaaattttcgattttaggtgatttttttgttttggttttttaaaatgttgggattataggtatgagttnttgtattcggtttattttgttttttaaaaaaaaaaaaaagtgagtattataatagaggggataaggaataatgtgtatgtgaggtttatttttgagattagagttataaaatagaattttgtattttagttatttttttattatacgcgtttttttggatatttttatttttttagtttatataatttaatatttttgtgatagagaggtgttggagttttttgttttgtttttgttttttcgtaattttttatatataaatagttatggttttttaggaaggaattttttttgttgagtatagaagtttgggaaaagattggtgaaattgtatgcgaggaagaaataggtttaattaaatgtgaatttatatttttaaagtaagggattataaagggtaggttttaaggaagttgtattgtttgttgtatttgttatacgggttgtattttttttttttatttatttttatttatagcgttgaaaattgaggttttaggttttggttgaaaatcgaggttaagggtgattagttagtgagttaaggaggttttagtcgaattttgttggaagtgttttagtataaagtttttttttagaattagtcgttattgagacgttttgaagttaaagtaatttatatttttgtttatttcgttttgcggtgaagaaatttcggtcgtataggttttagaatttattttggcgtgggttgtgatttattgggggatgggtttttttttcgttttagtttttaaatggagcggagcgttaggtggtgttagagggggcggcggtttttttaatggtggtatttttagttacggataaggttttaattaggtaaggacgtaagtaatgttgtcgtttcggttgattgttttttttattttttggaggtggtcggtgttataaaacgaatttttatttatttttaatagttatattagttttgttaattggatggtcgtagtttcgtgttttcgtcggacgtttttttggaatttttaggttattttgaggatggagattcgggtgttcgttttttttttttatcgtcgcgggtttgcgtttttcgtttcggatttcgattcggacgttttagtcgtacgtgcgggcgtttttgggtgcgagtcgcggatttacgagtcgttgtttgttgttttcgtcgtcgcgatttggggaagcgaaaatgaaattgattttttcgagaaatgatgaaagcggcgttgttcgttaatgagttgttgcggcgaattttcgtatttttcggtcgggtcgttcgcgtttttttttcgtttttatttttcggttgtataagtttgaaataaatattggggaggaagggcggagggaggagggcggagaggggaggcgagggagggagcgcggtcggaggagggcggggggtggggggatttttagtcgcggtttttcgtagttttttttttttgttttgttttcgatttggattgtttttaggtaagtcggggagtaatttttagttttgtttttgcgattatttaattgacgggtttttatttttattttatatattttagtaatatttatattttgcggaattgtattggtagcgtgaaaaaagtatattgagaggtaatattttttaaataatagttgtgattgtgtgtgtttttttcgagggtatgtttttggggattgtggggggtcgtgtgtgtatgcgtgttttgatgttttgatacgatgttttgtagacggaaaatgtcggggtttataaatattaatattgatttttggaggaatagtcggcgtaattatggattatttgattttaggggaagtaggttttgttgttgttgttgttgttattggggttgttgaggttgcgaggaggaggaggaggaggaggtagagagggaggaggaggaggaggttggtggaggtttaattttatttttggatttgtagatgcggagaggtggttttatggatatagatttgttgtgtgtgtttttgcgttttaggtgttgtgtgtgggggtgtaggttagttggagtcgggttttatttaaaataaaattgtgtgtatgtgcgtgtttgtgtgtgcgcgcgtgtgtgtgtgtgtagttatcgtcgttatcggattcgaaggaggggagcgggtttttttcggtgttcgcggcggcgtttttttaggttgtttttagcgtaaataagtaggtatcgtttttcggtcgggaggagcgtttttagttacggttagaggaaatttgttggggcgtttcgcggcggtttaggggttcgtttgtttgtcgggttcggggtcgggtcgcgggcgtcgggtgttagcggtcggggcgggagggcgggttcggagtcgggtcgggcgtcgggtttggtcgacgcgttttgttttttgggggttgggtcgtcgtcgtcgtcgtttagaagggacgtcgcgttttttttttcgtcggttagcgttcggtcgggttttggggttttgttattgtatttgttttagcgcgttaggggttcgggcggcgcgttttaggaaggtatcgtgtcgaggggttagtcgttcgggtcgcggtttagcgtcgtgcgttttcgggttttcgtaggcgttttcggtt

SEQ ID NO: 78 - DNA, 6071 bp, Artificial Sequence
  chemically treated genomic DNA (Homo sapiens)
  unsure (2618, 2780)
ggtcgggggcgtttgcggggattcgggggcgtacggcgttaggtcgcggttcgggcggttgatttttcggtacggtgtttttttgggacgcgtcgttcgagtttttggcgcgttgggataagtgtaatgataaagttttagggttcgatcgggcgttggtcggcgggaaggaggacgcggcgttttttttgagcggcggcggcggcggtttagtttttaggaagtagggcgcgtcggttaggttcggcgttcggttcggtttcgagttcgttttttcgtttcggtcgttggtattcgacgttcgcgattcgatttcgagttcggtaggtaggcgagtttttggatcgtcgcggggcgttttagtaagttttttttggtcgtggttggaggcgtttttttcggtcggggagcggtgtttgtttatttacgttggaggtagtttggagaggcgtcgtcgcgggtatcgagaaggattcgtttttttttttcggattcggtggcggcggtggttgtatatatatatacgcgcgtatatataaatacgtatatatatataattttgttttaaatgaggttcgattttagttgatttgtatttttatatataatatttggggcgtagaagtatatatagtaggtttgtgtttatggagttattttttcgtatttgtaaatttaaaagtgaaattaaatttttattaatttttttttttttttttttttttatttttttttttttttttttttcgtagttttagtagttttagtagtagtagtaatagtagtagaatttgttttttttaaaattagatgatttataattgcgtcgattgtttttttaaaaattagtattaatatttatgaatttcggtatttttcgtttgtaaaatatcgtgttaaggtattaggatacgtatatatatacggttttttatagtttttagaaatatgttttcgagagaaatatatatagttataattattatttgaaaaatgttattttttagtgtgttttttttacgttattaatataatttcgtaaggtataagtgttgttagggtatgtgaaatggaaatgaaagttcgttagttgaataatcgtaggagtaaaattaaaagttatttttcggtttgtttgagaatagtttagatcgaaagtaaaataaggagaggaaattgcgaagagtcgcggttggaaatttttttatttttcgttttttttcggtcgcgttttttttttcgtttttttttttcgttttttttttttcgttttttttttttagtgtttgttttaagtttgtgtaatcgggaggtggaggcggagggagggcgcgagcggttcggtcgggaggtgcggaagttcgtcgtagtagtttattggcgggtagcgtcgtttttattatttttcggaaaagttaattttattttcgtttttttaggtcgcggcggcgggagtaataagtagcggttcgtgagttcgcggttcgtatttaggggcgttcgtacgtgcggttagaacgttcgagtcggggttcggggcggggggcgtaggttcgcggcggtaggggaggagagcgggtattcgagtttttatttttagggtggtttgaaggttttaggagggcgttcggcgaaggtacggggttgcgattatttagttagtagggttggtgtgattgttgagagtaaatgaaaattcgttttgtgatatcgattatttttaaggaatgaaaggagtagttagtcgaaacgatagtattatttgcgtttttatttaattggaattttattcgtggttgagggtgttattattggaggggtcgtcgttttttttgatattatttggcgtttcgttttatttaggagttagaacgaaaaggaggtttattttttagtaagttatagtttacgttaagatgagttttggagtttgtgcgatcgaagtttttttatcgtagggcgaggtggataagggtgtgagttattttgattttaagacgttttagtggcggttggttttggagagaggttttatgttggagtatttttagtaaagttcggttggggtttttttaatttattggttggttatttttggtttcggtttttaattaaagtttaaggttttagtttttaacgttgtaaatggaaataaatgagagaagaaagtatagttcgtgtgataagtgtagtaagtaatgtaatttttttgggatttattttttgtggttttttgttttaaaagtatagatttatatttagttagatttgtttttttttcgtatgtaattttattagtttttttttagatttttgtatttaatagaggaagtttttttttgggagattatagttgtttgtatgtaaagagttgcgaaaaaataaaagtaaaataaaaaattttaatatttttttgttatagaagtattgaattatatagattggaaaaatggaagtatttaagaaaacgcgtgtggtaagaaaatggttaaggtgtaggattttgttttgtggttttggttttagaaatagattttatatatatattattttttattttttttattataatatttatttttttttttttttaagagatagggtaggtcgggtgtagnggtttatgtttgtaattttagtattttgggaggttaaggtaggaggattatttgaggtcgggagtttgggattagtttgattaatagggagaaattttatttttattaaaaatataaaattagttaggtttgggggcgtatggtttttaattttagttattntgagagggttggggtaggagaattggtttttttttttatttagtgtagggtgttttaagttatttatttattttgagtttatttttttatttgtaaaatattaattagtttaatttttttagagattgtttaaggatttggtgagaaaatatttttataacgttttttaaattaagttttaaagaaatataaaatattttattagttttttttcgatggtatgaatataaaattttgtttaagaagtgtattatagggttgggtgtggcggtttatgtttgtaattttagcgtttttggaggttaaggtaggtggattatttgaggttaggagttttagattagtttggttaatatggtgaaaatttatttttattaaaaatataaaaattagttaggtatggtggtgggcgtttgtaattttagttattcgggaggttgaggtaagagaattatttgaatttaggaggtagaggttgtagtgagtcgagattatattattgtgatagagttagattttattttaagataaaaagaagaaatgttattatggataatttttatgattttgtgagtattttaagagtatttaattaagttggtatatttttaaatgtattatttttaaatatatataggagaaaaaaatatgtgtgaggtttgaagggatgttgtttagaatgtaaatatattttgtgagatgtggggtggggatcgattgtggaggtagagacgagagagggagattttgaaaaaggaagtcgtaaggataatagattaaggttaaattaggagagaaatgcgtttagattttttgggtaagtataatttttatattaatgtgatagttttaatttagaaagtgtacgttttttaaagtaatttagtgaatggggtttattgtaggaattgttttagggttattaagtgtagtgaatattaaggggagtattatgatagagtttattgagggatttttttttttttttttttgagatagagttttgttttgtcgtttaggttggagtgtagtggtacggttatagtttattgtagttttgattttttagatttaagtaatttttttgttttagttttttaaggagttgggattgtaggtatgtgtaattttgtttagttaattttttattttttttgttttttagagatagggtttttttttgttatttaggttggagtgttacggtataattatgatttattgtagtttcgaatttttgggtttaagtaattttttcgttttagattttggagtagttgggattataagagtgtatttttacgtttagttaattttttatttattttattttttatatatggggtttcgttttgttatttaggttggttttaaatttttggttttaagtagtttttttattttggttttttattgggattataggtacgaattattatgttatatggaatttttgaattggggtttagaagaaaatgtagtaagttttgagagattgaggatgatgtttggttaaagggttggtttgaatatgaaatgtatttttattaatgttcgtgtgagggtttagaggtgttttggttttggagttaggagatgtgggttttaggtagtgttttgatatgttttagttgagtagagttgttttttgggagttagttttttgtttggtaaaattaggataatatgttttatttttcgggttggggagggtggtgcgaggagtagaaataatgcgtggaaagtaatttgtatcgtgttttgtaggagaggaagttgttgtttttgtttgtatgtgttaggttagttattgtagagatgtacgttttattaaaatatcgttatttttattaggttgtagagatattagggttatagtatagttgagatgaggagttgattgattttgttgggaggatttggagatgatttatggtaagagtattataggaagagagagaagtatttgttttttcgagtgttagggtggtagagaggttatcggaagtttttatttggttgaagatttgtagtgagtttggggtttaatttagaggattgagagaaggttagtattatgggaattgtttagtatgggggtttagggttaatagagagaattttgattgtatttaagaagaaaggcgaaattcggagttaggatagttgagttgagtaggaggttagagaagtaggagtagtatgtagaaagtgggttagtagtcgggagaggtttgcgaggtgggatgtgtatacggttgatgttggatatttggagttagggcgtgacgggggtattggttgattgtttagggtttatgttttatttttcgtttttatttattacgtttgtttatatttttttgtgtgggtttttatttagtttggttacgttttagtggtattcgtagttttgtttttttttttatttataaagagtataataaagagggtagtaaggttaggttaggtgagaggttatttattttggttagtaagtatgggtgaggtaggatatgttaggtttttggtaatttagaagtttttttggaagagatggaagacgtaattttatttagtaagaattaatttttttgtttatttattaattttattttttttacgtagttttttaaagtaatttttcgagtatttttaaagtcggaggtttggaagtgatgagaggttaatatgcgttttaatgagatatagttttgggttttattttatttttttgagattttagtttttgtttgttttttttatgtttattttttttttttgattgttagcggtagtcggtagattatatttttatgcggtagtttaatgtatttagttaatgtataaaggaagttagtggaaggttattaataaataatggattaaatagggagagtgtgaaagatgaatattggatgttttttaggattttgtatagttatttatatgtatatatattttgtaaatttttaagaagaaaatatagtatgtggtatgttttaaatttgattgttttatagaaaatgttatgagtttaattgtgtttttttaaaatttatatattgaagttttaatttttagtattttagaatgtgatggtatttgaagataagttttttaaaatgggaattaaggtaaaagggggttaggaaagtgggttttaatttagtttgattggtgtttttataagaagaggaggttaggatatagatatagatattatacgtgtgtatatatagacgaatgattatgtgaatatatagtaagaaagtagttatttgtaagttg

SEQ ID NO: 79 - DNA, 6022 bp, Artificial Sequence
  chemically treated genomic DNA (Homo sapiens)
attttttagtaatttttgatttttcgatcgttttattttttgtcgagtacgtttatttagttttataattgtttgttttttttttttttgttatttatgtatttgttcgtttgagagttttttattttatttcgaggttttttcggttttttggttattgttttttttcgggcggtatttatattatggttagataattttttttttattgtagtttttattttattacgggggaatatgagttaaagttatgtaattcgttgtcgggtaggaattaatagagttagtatatgtttttttcgtatttttttttttattaggtggttaggaatgtttcggattttcgtggttttgttatggatattttatttgaataagaagtaattttttttttagaattttagggggtttcgttattatagtataatttaatttttttagaaagatatatttttttatttagtatgtttagagttttatgtgtgataagtgacggtatgttgttttataaaatttcgttgaaagagtcgttgatgaattttagaataatttaatattaggcgttgttataaatgggtggaattagataaagtcgtttgttttttattttttgttttagtttttagaaaattgtttaaaggtattgtaaattatttgcgtttttattggtttggttaaggagttggtagtgttaattggttttgtgtaaagttacgttattgtttttgtagagagtatgatacgttagagaggtgggaagtgttgttaggattttttttagaatgttggtaagaagagtaggcgaaaagggaagagttgtttataaatagggaaaggagatattatttcgtatttttggttttttattacgttatcgattataattataagttttattttttataagtttgaaagcgggtttttttttgtatgtaggaaaaagtttcgtttattaattttgtttttaaagagattataagttggttttgaacgttttgtgttttgggaatgtttattgtcgaagttttgtaaatttttttattgaaggtatttagggtattttgttaattaaattaggaaaatgtgtatagttttatttgaaaaaatttaggtttatgttttgtattttattattaaagaatttattattttttaaataatatttaattattttaaattgagtgtgtagtgagagtatttataatataattttatttttagagtgttttattttaatttttttttggtataagtagtttagaaggttagattttttttttttagaggattaaatattcgagaagagtggttaagaggtagtattaggttttttttatttttttaaagagaatttagttttgtgaagaagaataaagtgaaggttaatggttagatttatggtttaaaaataaaatgtagttttttttattttgaatttattataattaaaaaggttacgaggtagttattaatgattttaagttgtaatagaaagaaaaaaatatttatttagggttaaacgaggatttagtggttatttgtcgtcggtttttattttataggggcggaggatgaggttagggaagatttttttatttatattgatttgattagagatgaaatttttttttttatgatagtttgtatttagaggttgattttgaaatagttatgttaaatgtagttaatttttgtgtataaggagaaaaaatagttttttagagttgtgtttttgggttagttatttggattttttataatttttttcgttttttttatatttgggttgaatttcgttttttttgtttgttaggtttggtttgggggttaaatgagtgaaagttcgtgagatatttttaagtattgaagtgcgtagtaaatgataatagttttgatttgttgaatatgatgatgtgttaggtattgcgtaaagtattattttattattataataaatattgttgggaggtagggatatttttattttttttgtatatttagaagtaggattttggttaaatggtttttttaaggttttatagttttaaaaatttaagtatttatttaatttttaatgatattattttttggttatgtaatgtgttatggttagtaattagatttgtaaatatatataattaaagaggattagaagagatatatattttatataaattatatgaaaatagtatttttagtatttttttgattttttttggtaattaaaaatgattgttttttatatttttttatggatatagttgtattgtttttagttaattgtagtttttttttttaaagagtgaattagtgggaaaatagtgttatttaagattttaagaatttagtgtgtgtgtttgtgtgtgtaggatgggtttttttgaaatattttatttgtatgtgaatgtataattttaaagattggtttttaaaatattgaattgaggtaaatttagttttttttgtagattttttacgataaatgtgaaattgaaaatggaaatgttttatttagatggtgtgtcgattataattttaatatacggataatttattaaataagtaattttttcgtggaatattacggttagtttttgttttgggtatatatttaatgaattggttttttattagtttttgtttgttaataagttgtgttatttattgataaatatttagttttttattaaggaatatcgatttttttaagttttagtgtgtggagggggtgggagtttggtggggaagttttttaatttgagaatttttgtcgttttttgttttaatcgtgattaagatataaaagtttttggttattattgttagttgttatttgtttattgtttttttgacgggtaatgaggttattcggagttttagtgattaaaatgttttattatttgtatttatattattattaagaaaaataatttttagtggattaatatggtaaatgagtaaattagaagatggcgttgaagattagtaattatatttaaaaataaggtagtggtgtgaaggtttagagttttatataacgattgttgttttgaattaaaagtagaggatgtggatgagtgaggggagggtatgttgaaaatgattaaattcggtgtagaggatacgtatacgaaagtgtaaaaagtttttatttgttattttttgtttttagtaaatttttttttggtatgtttgtgaacgtttgagggaaaggtaatattgattaaaatataatgtaataagaaggtaacgatttttgttttgtttattgatgtgttttaagtgtttaggacggtttttgataagtagtaggtgtttaaaatatatttgttaagtgaataaatttgtgaaaggaaaggaagaaaaataggttgtgattagaattttttgtgaataaaattttgttgtttattatatagattttggtaatggaaaatttatttgggtgaaataaaaaatggtattttgttaatttttgagaacgtttgttggttttaggaaaagtatatttatttatattttattatttgttttgttttagtttaaatatagatttttttttggttaggagatattgatttaatatataagattaaaataaaaattgagaaataagtgaaattaaaagttttttaaaagttgtaggttgatttacggtggtggtggtttaaaattatatagaaattagagatttgatggtttatttgaaaatgcgaagtaaatgtatatatttagtattttagacgatcgaaagtttaacgggtgaaagtttagggggttaattttgcgattaaggatattttggaaaagtatgtaaaatttttggtttatttaagtattatttttattttgggtttttatttatttattttgagatggagttttgttttgtcgtttatttcggtttattgtaattttagtttttcgggtttaagcgattttcgtggttcgtttttttaagtagttggggttacgttcggttaatttttgtatttttagtagagatggggttttatcgtgttggttaggttggtttcgaatttttgattttaggcgatttatcgtttcggttttttaaagtgttgggattataggtttgagttatagcgtttggtttattttgggtttttatattttattggtaaattgtttttttttaggttgaggttaaaacgatattattttaaggtgaattgaagtttggaagtgattaagtatttggatttttagggagttttttttcgtttttattttttttatgttaagataattaaaatttcggggtcggggtattgtttgagttattttaatttattagtttaatagatgtaaaaggatgtaagtatgttagatacgtagagatagtatttgaattaagtttaatagtttaagggagttgggttattttttattttttttttagtgagtgcgatgttttttaaatatcgcggagaggtagggttttcggtgatggttttgtcgagggtgttttcgtaatttttatttttagttttttttggattattttttcgtttttcgttatacgttttgtaaagcgaagtttttttcgtattagattttcgttattatacgttttttatttttcgttttggttatatcgttgtagtttagtgattgattggttttttgaggttttggcgtaaaggcgagattcgtatttcgtatttcgtttttcgcgggaaacggttttagtgatagttttcgaagcggcgcgcgttcggttggaggtgcgtttttcgggcgcggcgcgcggagggtcgttaagggcgcgggaattttatttcggtcgcggtagtttttagtttttacgtcggttttgaggttcgttcgttcggtcggtttcggttttcggtttgtaaagtttttttttttagtttaattttcggtttttataggtttcggcgtttcgtttcgttttaggtttcgttttagagagttttataaagttttttttttttatttcgtatttttagttttatcgttcgattttgggatttatcgttgtttttagtttcgagtttagggcgaggtaagggttggagtcgggtaggaggaggggtgtgaggttgatattagagaggattcggagcgcgaattagaggttcgatttttagggtagcgtagggtatttcggtttcggagcgggaagggagcgcgtttcgttttggagtttcgatttttattttatttgcgttgagtcggaggcgcgggtttgggttttaaggttcgtttttttggttttgttcgagttttttcgtttgtttttcgcgtttttgcgacggggtcgttataagttggacgggatgagttaatcggattgtcggggtttttcggggttcggcggacgttttgcgcgcggaatttttcgtattggggttgtagttttcgcgtttgcgttatttgtcgtttgtagagtttatttagtgcgcgttagttgggtagggataggggttttattcggggcgaagggtttggatgcgagtagagaaagcggagggtggaggaattcggggttgcgtttttggaacgttcggtcgtaggcgaggtttttcgcgcgtggaggtcgttaggggagtggaaattgatagagtcgcgggaaggggcgagaagcgggttgggagtgagcgaaggtaagcgagagttgcgagtgagtgcggaaggagggttaggaggggtggcggttgggtggggagagagggtgtaagacgagcggcgcgtgtcgggagtttttgggttgcgggtgcgttataggagagtaggcgggtaggagttttcgcgggggtcgagttcggaaggcggacggttgtgttcgtttaggggatgcgttcgggtcggtcgcgaaggtgttttttttcgggggttcggacgattttgatacggtacgcgcgcgtttcgtagttttaaagatttcggggtttcgtggttattggcgtaggggatcggggcggggtgttcggagtgcggtgtttcgtggttgaagggtagttttttttttcgtagt

SEQ ID NO: 80 - DNA, 6022 bp, Artificial Sequence
  chemically treated genomic DNA (Homo sapiens)
attgcggggagaagagttgttttttagttacgaggtatcgtatttcgggtatttcgtttcgattttttgcgttagtgattacgaggtttcggagtttttgaggttgcgaagcgcgcgcgtgtcgtgttagggtcgttcgggttttcggaagaaggtattttcgcggtcggttcgggcgtattttttgggcgggtatagtcgttcgtttttcgagttcggttttcgcgaaggtttttattcgtttgtttttttgtaacgtattcgtagtttaaaggttttcgatacgcgtcgttcgttttgtattttttttttttatttagtcgttattttttttggtttttttttcgtatttattcgtagttttcgtttgttttcgtttatttttaattcgtttttcgttttttttcgcgattttgttagtttttatttttttggcggtttttacgcgcggaggatttcgtttgcggtcgggcgttttaggggcgtagtttcgggtttttttatttttcgttttttttgttcgtatttagatttttcgtttcgaataggatttttatttttgtttagttagcgcgtattaagtgggttttgtaaacgataagtggcgtagacgcgggggttgtagttttagtacgggggatttcgcgcgtagagcgttcgtcggatttcggagggtttcgatagttcggttagtttatttcgtttagtttgtggcgatttcgtcgtaggagcgcggagggtaggcggggaggttcgggtagagttaaggaggcgggttttggagtttaaattcgcgttttcggtttagcgtagatggggtgggagtcggagttttaggacggggcgcgtttttttttcgtttcgaagtcggggtattttgcgttgttttggaggtcgaatttttggttcgcgtttcgggttttttttggtattagttttatatttttttttttgttcgattttagtttttatttcgttttggattcggagttgagggtagcggtgggttttaagatcgagcggtgaaattgagagtgcgaggtgggaaagaggaattttatagaattttttggggcggggtttggggcggggcggggcgtcgaggtttgtgggggtcgggggttggattggggagagggattttgtaagtcgagagtcggggtcggtcgggcgggcgagttttagggtcggcgtgaaggttgggggttgtcgcggtcggggtggggttttcgcgtttttggcgatttttcgcgcgtcgcgttcggagagcgtatttttagtcgggcgcgcgtcgtttcggggattgttattggggtcgtttttcgcgaagggcgaggtgcgaaatgcgaatttcgtttttgcgttaggattttaggaggttagttaattattaaattgtagcgatgtggttagggcgggaaatggggggcgtgtagtagcgggaatttggtgcgaaggggatttcgttttgtagagcgtgtaacggaagacggaggaatggtttaaagagaattggaggtggaggttgcgggagtattttcggtaaggttattatcgggaattttgttttttcgcggtgtttagagaatatcgtatttattaaaaagaaaataggaaatggtttagtttttttgagttattaagtttgatttaaatattgtttttgcgtgtttgatatgtttatatttttttgtatttattaggttggtgaattgaagtgatttagataatgtttcggtttcgaagttttaattattttagtatgaaagagatgggggcggggagaggttttttaaggatttaagtgtttaattatttttagattttagtttattttaaaatgatgtcgttttaattttaatttggaggaaagtagtttattagtggggtataaaagtttaaaataggttaggcgttgtggtttaagtttgtaattttagtattttgggaggtcgaggcggtggatcgtttgaggttaggagttcgagattagtttggttaatacggtgaaattttatttttattaaaaatataaaaattagtcgggcgtggttttagttatttgagaggacgagttacgagaatcgtttgaattcgggaggttgaagttgtagtgagtcgagatgggcgatagagtaagattttattttaaaataaataaataaaagtttaaaataggaataatatttaagtggattagggattttatatatttttttaagatgtttttaatcgtaaaattaattttttgagtttttattcgttgagttttcgatcgtttgagatgttgagtatgtgtatttatttcgtatttttaggtaaattattagatttttggtttttatatgattttagattattattatcgtaggttaatttgtaatttttgaaaagtttttgattttatttattttttagtttttgttttaattttatatattgggttaatgttttttaattaaagaagaatttatgtttaggttagagtaaaataggtagtgaggtatggataggtatgttttttttaaaattaatagacgtttttagaaattaataggatgttattttttattttatttaagtaagttttttattattaaagtttatgtaataaataatagggttttgtttataaaaagttttggttataatttgtttttttttttttttttttatagatttatttatttgataaatgtattttgagtatttgttatttgttaggaatcgttttaggtatttggaatatattagtgaataaagtaaagatcgttgtttttttgttgtattatattttaattagtgttattttttttttaaacgtttataaatatattagagaggagtttgttgaggataaaaaatggtaaatgagagttttttgtattttcgtatacgtgttttttgtatcgggtttagttatttttaatatattttttttttatttatttatattttttgtttttagtttagaataatagtcgttgtgtgaaattttgagtttttatattattattttgtttttaaatgtaattgttaatttttaacgttattttttggtttatttatttgttatattgatttattagaagttattttttttaatgatgatgtgaatataagtaataaaatattttaattattaaaatttcggatggttttattattcgttagggaggtagtgaataggtagtagttggtagtggtgattaaggatttttatattttagttacgattgaaataaaaaacggtaaaggtttttaaattgaaaagtttttttattaaatttttattttttttatatattgagatttgagaaaatcggtattttttagtaaaaggttggatatttattagtaaatgatataatttgttgataagtagaaattaataggaaattagtttattgaatgtgtatttaaaataaaggttgatcgtgatattttacgaggaagttatttatttagtgaattattcgtatgttgaggttgtagtcggtatattatttgaatggagtatttttatttttaattttatatttatcgtaaagagtttgtaagaaaagttgaatttattttaatttagtattttaaaagttaatttttaaaattatatatttatatgtaagtaaaatattttagaaaaatttattttatatatataaatatatatattagatttttaaaattttggataatattatttttttattaatttattttttaaaggggggggttataattggttaaaaataatgtaattgtatttataaagaaatataaagggtaattatttttaattattagaaaaaattaggaaaatattgaaagtgttatttttatgtaatttatatagaatatatgttttttttaattttttttggttatatgtgtttgtaaatttaattattggttatgatatattgtatggttaaaaggtagtattattggggattaaataagtgtttgagtttttaaggttgtgaggttttgggagagttatttaattaaagttttatttttgggtgtataaggagggtgggggtgtttttgttttttagtagtgtttgttgtgatgatgaaatgatgttttgcgtaatgtttggtatattattatgtttaataaattagggttattattatttattacgtattttaatatttaggggtattttacggatttttatttatttggtttttaaattaaatttggtaggtaaggaaggcgggatttagtttaagtgtagggagaacgaaagagattgtgagaggtttagatggttggtttaaggatatagttttgaggaattattttttttttttgtatatagggattggttgtatttggtatgattattttagaattagtttttgagtgtaggttgttataggagggggagttttatttttggttaggttagtgtgggtaagaaagttttttttggttttatttttcgtttttgtgaagtggaggtcggcggtaagtgattattgaattttcgtttaattttaagtaggtgtttttttttttttgttgtaatttaggattattaatggttgtttcgtggtttttttggttatggtaaatttagagtaaggaaagttgtattttatttttaagttatggatttaattattgatttttattttatttttttttataaggttaaattttttttgaggaaatgagagaaatttggtgttgttttttagttatttttttcgaatgtttaattttttggaaaaaaaaaatttaattttttaagttatttatattagagaggagttgggatggaatattttggaaatgagattatattataaatgtttttattgtatatttagtttaaaataattgaatgttatttgaaaagtgataaattttttggtaatagaatatagagtataaatttggatttttttaagtagagttgtatatatttttttaatttaattagtagaatgttttgagtgtttttaatgagaaaatttgtagagtttcgatagtaagtatttttagggtatagggcgtttaggattagtttgtgatttttttgagggtagagttagtaagcggggtttttttttatatgtagagaagaattcgtttttaggtttgtagaaaatgagatttgtgattgtaatcgatgacgtaatgagaagttaaggatacgaggtgatgttttttttttttgtttataaatagttttttttttttcgtttgttttttttgttagtattttaagaagagttttggtaatattttttatttttttgacgtgttatgttttttatagaaatagtgacgtggttttatatagggttagttgatattgttaattttttaattaagttaatgaaaacgtaaatggtttgtaatatttttgggtaattttttgaaaattgaagtaagaggtgaaaggtaaacggttttgtttaattttatttatttgtaatagcgtttaatgttgggttattttaaagtttattaacggtttttttagcgaaattttgtgaaatagtatatcgttatttgttatatataagattttaggtatgttggatagaggagtgtatttttttagaaaggttaggttatgttgtggtaacgagattttttgagattttggggggggggttattttttgtttaaatgagatatttatggtaaagttacggggattcggaatatttttggttatttgatggagagaagggtacgggagaagtatgtgttggttttgttagtttttgttcggtagcgagttatatggttttggtttatattttttcgtaataaggtaagaattatagtaaaggaggaattatttggttatagtgtgggtatcgttcgagagagaataatggttaggaggtcggggaggtttcggggtgaggtagagagtttttagacgggtaggtgtatgggtggtagaggagggaaggataagtagttatggggttgagtagacgtgttcggtagggggtggggcggtcggggagttaggggttgttggagggt

SEQ ID NO: 81 - DNA, 9091 bp, Artificial Sequence
  chemically treated genomic DNA (Homo sapiens)
ttggttttaagttgtagaggtttgagatggatttggtttagaaatgttttagagtttgaggttggtggttttttttattttatattaaagacgggtggatttcgtgggtttggttgggatatttgtagatgttgagttttaataaggtttattttgggataaaagtgtatatcggaggtttttggttggtgtttgtggggttggattggtatttgtttttataaagtagtggttttagaaggttggggtttttagttagattttgttttttttttttttttttttgtttaggtgttttatgttttatagcgagttttcgagatatgtaggaaggatggatgttttatttttttcgtaatagagtttaggagtagggaaggaagtggtttgagtatagtgttgagttaagtaagttttagaagtattgaattagattacgtgtagttagtaggggaggagagaaattttgggtcggtgttttggaggttcgcgggggataggggtatagaggcgtagatttaggatgttgagttgggagaggaatttcggaggaaagtgagagggttttagtacgtttatttaaaggggatggtgagaaatttaggaaagagtgaaattttaagatttgagggtttaagtgagagaggtaggtagagattggagttttgggggagttttcgtgggttttagggtttgtttgagttgtggatttaaggtttggaggatagggtggggttagaatagattttatcgataagggtaggagttaggttgtaggtattagagaggataggtgatttgtcggggtttggagtaagggttcgggtagttttttttataggttatgtgaagatagagttatggattgggaaaggtggagatttcgagtgtagaggtgtttatgtaatagtgttggttgaatgggggatttttaggttatattttaaaaagttttgagtcggtgttagtaagaaatggggaggaaggtttagttgtggcgttttgggtattaattttaaaaaaaaagatattatttttatgtgttagaaattttaaagtaagtgaatattttaagtacgagaattagaggtgtttttttgttttttttttttttttttgagacggagtatcgttttgttatttaggttggagtgtaatggtgtaatttcggtttattataattttcgttttttgggtttaagtaatttttttgttttagtttttcgagtagttgggattataagtatgaattattacgtttggttaatttttgtatttttttttttttagtagagacggggtttttttatgttggttaggttggtttcgattttttgattttaggttatttatttgttttagttttttaaagtgttgggattataggcgtgagttattttattcggttaagaggtgttaaaatttaaattagattatgttatgttttagatttgaattttttagtgattgtttttagtaaagttatagtttgtgaggtgttttttaaggttttattcgattttattatttgaggatttatcgtttattttattttgtagaatggaagttttaggagggtaggggtttttagataaagtagaaattgtttattattttattttggtaggtataatatgttcgataagtattgttgaatgtagatttatagttaattcgtgatattggtgttattatttttttttatagatgggaaatggggtttttgggggagtgaatggtttgtttaggttacgtaattttagattgtagagtgaggatttgatttagatttgttgattttagagtttgatgtttagttaataagtttttagaaattcggggtttttgagaaataggatagttagttggggattttgagaagttaggtcgagggggttgggtttttgaggtagaggtttgagaggtaaggtagttgttattaattaggttgtattgaagggggttgatttatgagtagggtgtattgtttaggttgttagtggttttatggattttatttagttttttttggtgatacggtttttttttttttttttgttttttattttagttattttattttatattcgtttatatagcgtagtttttattcgagttaggggagggtgttttttattatatttttagtttgtgatattttagttaggggaaatgggggaaggggttattttattgtggggagtggggggttcggatagatttttttgtttttatcgttttttggtttattaaggggaaatgggagtgtttatataagggtcgggtgtggttttattttttttttatttgtttttttatttttaggatggtattgggaggttaagggattttagattttggaaatattggagtgttgttttttgtttttttttttttttgggttatgtttttggttttagatgatttttggtttaggtttttttagttgagggaagttaggatttgagttaagttgagtttttgtatagtttttatttcgggagttttatattaatgttgtcggtttggtaatattattttttttttagagacgaggaaatgagatttgaggttttatttaaggttatttggttggaatatagtaaagttaggtgtaagttttttttttgtacgtagttcgtgttgttttttgaggtttagaggttttaaggaaggggttttatttgagtaagatggatagtgggaagggggtagagggtagaattttagggttttacggttttttagaatgggtgaggagtatttgataataaaagaaggttttttttagttattgttttagatacgattagtatagaatatttttttattaagtataattgatttttagtgaaaaaggtttttattttgtggggagttatttttgaaatagtaattttattttattattattattttgagataagattttatttttacgtttaggttggagtgcggtggtgtgttttttgggtttaagtaatttttttattttagttttttaagtaggtggaattataggtgtgtgttattacgttaggttaatttttgtattttttgtagagataaggttttgttatattgtttaggttggtttcgaatttttggatttaagtgatttgtttgttttagttttttaaagtgttgggattataaatgtgagttatcgtgtttggtttagtaattttatttttaaagaaagaaatataaaacgatttatttatttatattttttttatttatattttaaattttaaaaatatgaaataatgaaatatttagtagatataaataataaaatatttatatataatgatatttcgattttatattagggttttaaaggttaggaaagagggagagatatagaagagaaaaaaaaaaaacgttaatatatgagtgtttttttttaatttgttaaaggtaaagtttaatttaggagaagggaggggagggaaggttaaagttttgatttattaataaatattattttatttgttaaaaatataaggttttgtttggcgtagtggttttcgtttgtaattttagtattttgggaggttaaggcgggtggatcgtttgaggttaggagttcgagattagtttggttaatatggtgaaatttcgtttttatttgggaggttgaggtaggagaatcgtttgaattggggaggtagaggttgtagtgagttgagatcgtattgttgtattttagttcgggtgatagagtaagattttatattaaaaaataaaataaaataaaatgaataatgaaaagataggagggaggtttttgagtaagttgattcgagtggaaattagatattaaaattgaaattcgttgaattttttaaaaagttagatgtttatagaattgaagtttgagatatttatattagtatatttgttgtttgttgattaattttttttttttgttttttttgttttttttttttgttatataagtttttaattttagttaaggggagggatggattggaggtttgtttttttttttaatagtttattggttgatgttatcggaataaagttttttttggtaatattcgttgttttagtgataggttttttgtgcggtgagtagttagatttggattaaatttttggtaatttataataaaattataagtaaaattaattaggaagttatttgtattttggaattttatttgggaggggaagttaaggtagattttttagagaaggcgatgttgaaaattttagaaatagaaattttgaagagtaagagttattaagcgaagaatattttatgagaaggaataggaggtgtgtgaaggtggaggttttggggtgaggttttttatggaatcgaaaacggtttagaattataggtcgacggttaaggtagtagtgagaggaggtgggataggcgattacgtcgttgtttttgggatgattggaaggcgatttaggggagttggggcgagataggtgtagggtttgaggatgagaaaggtatagagtgattagaggattttcgtttgtaagtatatttggaaggggtgtttggattttgggggtagcgattgtgttttagggcgagagttattttcgttaggggtgtaggtaggcgagaggagggtttggagttgtgggtcggttatattgcgtttttatttgtgtgtagtttcggaggattagagtggggaagtattttatttttttttagggtttaattgagtattgtagcgggaggtacggggttgttaaatgatagttttgttattttagattgttaaaagagttagtggttagtttagggtatcgcgtcgtttggtatttttttggaggttttgggtttggttcgaggtttagttcggatttgtagttgttaggttagtgcggggttcggagtggattcgcggggcggggcggggtattgttcgcgttcggagtttagtagtagttgtttaggggcgggggcggtaagacgcggaagtgttcggtaggttggcggatcggcgggaggcgtagtttgggtagagtttagtttggtttcgtcgttcggtcggtgttttttggcgtagttacgtaggcgtatcgtagataggtgggtttcggtcgtcgcgtttttttttttgcgttcgcgttcggcgcgtttcgagggtggcgagagcggtgttcgttattgtttttaagtttaggtttagattgggtttcgcgttttttaggtattgcgggcggcgggatgaagattggagtagggcggggttcgcgtttagttgcgtttggaaagcgagttcgggggggtgtttatagtagggtgcgttcggtcggtttgggatttttaaagcgttttttacgtttcgatcggtttggggtgttggcgttcggggagtttagtgatttaggcggcggagtgggtagcgttgcggggggcgtcggttttgttgttttttttttttttcgttatcgtttagaatgggggttttcgggagtttcgttggaggttggtttggattatagaggagcgaggttcgatttttattttcgatgtattcgtttttgtttttatcgggttatttttattttttcggaaaagaggttgaggttaaagcgtttatttttcgggatttttaggttaatggtaggaattgtgtaagagtttgggggaagatggtgttaggtagaggttgcgtttttgggttcgcggtcgggaatggtagattttcgtttttcgagtagcggaaaaggatggggcgtaatagtttttgggttggtttttttaggttttgttttagaatttaagaaggtaataatgaagaggttaaacgtggaggaaaagtgaggttagtatggtcgggatgcgtggggagatggttgttttcggatttcgggaggggcgggagcgggtatttgggagtagaggttggagtgggggatttttttagtttcgcggttacgttgaatatagtagggcgaggatcggggtgttgtttttttagtagtaggaggagaggtttagaggtcgattttggaggtgggggtggtttcgcgggttggtttagggggtgtgttttagcggagtacgcgggaggggtgggggcggaggattgggttgggtttgggtttttcgagggtttagaatggggataagtgattagaattagagagggttcggttgtatcgatgtaggaaattgtagttttttaggaggttttttggtaagattttttttttttgtttttatttttagtagttatggggtttggggtgttggggttgaggggttttaagagttaagggaagtattgggaaattattttttttttatttaaaggttttattttggggttttttttttgtattttggtttttttttattttgattttgggaggaagttgaaagaagtttttttttgggtattttttgttttagagttttagtttgtttggattaggtgggtagtagggtttagggtgtgggtagttgattcggaggggtgggatttgggggttagggtttgtatagggaattttttgttttttttttgagttgggtgtgggtttgtaaggagatatgtgatttagattaattttgggagtagtagggcgtttgttgtttggttatttttattaggattgttgtggtatttttttttttagtgggtttttggtgtttatgaattgtagtttttgggtggtggtgggggtattgttttttgggattttagtatggttttggggtgagttgtgggtttattttattttagtaggttttttagggttgtttattggatgtttcgttgttttatataattgtagggatttttttaggttgttggatttttttatttttcggggtttaggtttattgatttaggtttagggttttatatattttatttagagatttcggagtttggtaggtagatttgttttgatatcgaatttttaaagttatgggttttgattggggtggtttgaattagatttagtttttttttgggtagaagggagtttttaggaggatggatgttgttcgggttagagttcgtgtggatttagttgtaggtaaaagttttgaggttgagttttttttgtggtatggtggatagattttcgtttattatagtcgggtttgttacgggagttttttttttatatttttttttaagttgtttgtatggacgcggttttttgatattgaggtcggagttattattttaaaattttgttttgtattaaatagtcgtgttgggtagggttagattgttggattgatagtagggggtaggtagtcggattttttgagttttttaacggtattagcgtttgtacggttttagtttagggggttattagggaagtttttttcgattttgtgtagatagagttttttttgtttatttttgttcggttagaattgtgtgtcgttggtgattggtatttttttattttagggttaaggttttttaggggtttatagatataattatgggtgggtgtatatttatgttataaattatattaaatgtataaaaattgtttgtaagtttggggtgcggggaatagttttgggtgggaggttggaaatttggtttgggggatttattcggtttttttttttagtttatagtgagtttggtttttgagttgtttcggtttagttattttcgttttttttggggtcgggtggaggttggggtagaaagcggaattgagttcgcgtgttttgaggttagggtagggttggagcgttttgaatattttttcgttttagtttttgggttaggtaagggtcggttttattttttttgggttggtggtagtagagttgggttttgagggaggtttgtaatgtgagatagtagtagtttagaggcggtattaggtaggtgtaattttaaaaggtattgggtagggaattttaggggaaattgaggttttatgttgtaaggttaaagtaggtttagatatagggagtttagttcgaacgtttgttttttatttgttgatcgatatatttatttttgatgggttgtgttgtgtaatgatttagttttttttgttttttatttaggggttttaagtgaagggttaagggtatgggtaaggggaggagagggatagaaggggatttaggattgtggagagttttcggttttgggttggagagggagttgggtaggtgaaggggaggaggtagggtttttttggtttgattttagggaggtagtgaagttgtggtttgggaggcggggttcgtgtttttgggtaggtagtagttagagttgtggtttttgttttttgtagtttttttaataggtttcggtaggcgttagggtttttttaagtgttattcgaatgcgtgtttagtgggaggagaagggggaggattaagaatttagatgaatggttttagagaggtaatatttgtttggtgtttgttgttattggaggtgggttgagttggttgatgggatttttttaaagatattgagaaattgtttttttttgagggtaggtgtttttgggagttttagatgagatttttgttgagggtattttcggagggaatttttaggggatggagggtgagaaaatttgggtagggaagaatcgaattaggggtgtagattgagtaggaggttgttttcgggttgattttatagagcgttcgttgttttaggtagttagtttgagataagatagtcgggtttttggtgttaggtagttattggttgtgggttgttttttaagagtaaggggtgggtttaatttgtggtgtgagtagtggaaggcggttttttggttaacgggttgtttgttgttgttagtagttggagaatggatgtttttgttcggtaaagggtatttggggtcgcgttcgtagtatttattaattcgtaattttttttttttttttttaaatataaaattttatgatattagataagaaagttgatgtttggaaaagagaattggttttaaatatttagatggattggagagattattttttgtggtttatagtttgatttttgagtattttgtttttatttatttgtagatttgttgaggtttttttttggtttttttttgtaga

SEQ ID NO: 82 - DNA, 9091 bp, Artificial Sequence
  chemically treated genomic DNA (Homo sapiens)
tttgtaggagaaagttagaggggagttttagtaggtttgtaggtggatggggatagggtatttagaggttaagttatggattataaaggatggtttttttagtttatttaggtatttaaggttaatttttttttttaagtattagtttttttgtttagtgttatggaattttgtgtttggaggaagggaaggagagttacgagttagtgaatgttgcgggcgcggttttaggtgttttttatcgggtagaggtatttattttttaattgttaatagtagtaagtagttcgttggttagagaatcgttttttattatttatattataggttaggtttattttttgtttttggggggtagtttatagttagtgattgtttgatattaaaagttcggttgttttgttttaagttggttatttgggatagcgagcgttttgtgggattagttcgaagatagttttttgtttagtttatatttttagttcgatttttttttgtttaagtttttttattttttattttttgagagtttttttcggagatgtttttaataagaattttatttggagtttttaaggatatttgtttttagaggaaagtagttttttaatatttttagagaaattttattaattaatttaatttatttttaatgatagtaggtattaaatagatgttatttttttagggttatttatttaggtttttggtttttttttttttttttttattggatacgtattcgggtagtatttaggaaggttttaacgtttgtcggagtttgttaggaaggttataggaaatagaagttatagttttaattgttatttatttaggggtacgagtttcgttttttaggttatagttttattgtttttttggagttaggttagagggattttgtttttttttttttatttgtttaattttttttttagtttagaatcggaaattttttatagttttgagtttttttttgttttttttttttttttatttatgtttttggttttttatttgagatttttgggtggaagatagaaaggattgggttattatatagtatagtttattagaagtgaatgtgtcggttagtaagtaaggagtaaacgttcgagttgaattttttgtgtttgggtttgttttggttttgtagtatggagttttagttttttttgaaattttttgtttagtattttttggggttgtatttgtttagtgtcgtttttgagttgttattgttttatattgtaggttttttttagagtttagttttgttgttattaatttaggagaggtaaggtcggtttttgtttggtttaggggttgggacggggaggtgtttagaacgttttagttttgttttggttttagaatacgcgggtttagtttcgttttttgttttagtttttattcggttttaggggaaacgaaagtggttagatcgggataatttagaaattagatttattgtgggttgagggagggagtcgagtgggttttttagattaaatttttaattttttatttagagttgtttttcgtattttaaatttgtagatagtttttgtgtatttagtgtggtttataatatgggtgtgtatttatttatagttgtatttgtagatttttgagaggttttggttttagaatagaggggtgttagttattagcggtatataattttggtcgagtaagggtggatagaggaagttttgtttgtatagaatcggggagagtttttttaatgattttttgggttgaggtcgtgtaggcgttggtgtcgttggggagtttagagggttcggttgtttgttttttattgttagtttagtagtttggttttgtttaatacggttgtttaatatagagtaaggttttgaaatgataatttcgattttagtgttagagggtcgcgtttatataggtagtttagggaggggtgtggaggaggagttttcgtgataagttcggttgtgatgagcgagagtttgtttattatgttatagaagggatttagttttaaggtttttgtttgtagttaggtttatacgagttttaattcgaatagtatttatttttttagaagtttttttttgtttagaaaagggttaggtttaatttagattattttaattaaggtttatgattttggaagttcggtgttagaataggtttgtttgttaggtttcggagtttttgggtgaaatgtatggagttttagatttaagttaatggatttgagtttcggaaggtggggaaatttaatagtttgaggaagtttttataattgtgtgaggtagcgaagtatttagtgggtagttttagaggatttgttgaggtggggtaagtttatagtttattttagggttatgttggagttttaggagatagtgtttttattattatttaggagttgtaatttatgggtattagggatttattaggggaggaagtgttatagtagttttagtaagagtggttagatagtaggcgttttgttgtttttagggttggtttgggttatatgtttttttgtaaatttatatttagtttagggagaggataaggggttttttgtataggttttgatttttaaattttattttttcgggttagttgtttatattttgggttttgttgtttatttggtttagataggttgaggttttggggtaaaaggtgtttagaaagaagttttttttagtttttttttagggttagggtaggggaagattagggtataggggaaaaattttaaagtagggtttttagataaaaaggggatgattttttagtgttttttttgatttttggaattttttagttttagtattttaggttttataattattgggggtgggggtaggaaggggaggttttgttagagggttttttgaggggttatagttttttatatcgatatagtcgagttttttttggttttggttatttatttttattttgggttttcgaggagtttaggtttagtttagtttttcgtttttatttttttcgcgtgtttcgttggggtatattttttgggttagttcgcggagttatttttatttttagagtcggtttttggatttttttttttgttgttggaggagtagtatttcggttttcgttttgttgtgtttagcgtggtcgcgaggttgggaaagttttttattttagtttttgtttttaggtattcgttttcgtttttttcggggttcggagataattatttttttacgtatttcggttatgttagttttattttttttttacgtttagtttttttattgttgtttttttaagttttgggataggatttgaggaaattagtttaggaattattgcgttttattttttttcgttgttcgggggacgagagtttgttattttcggtcgcgagtttagggacgtagtttttatttgatattatttttttttaaatttttgtatagtttttgttattggtttgaagatttcgggggatgaacgttttaattttaatttttttttcgaaagggtgagggtggttcggtaagagtaagggcgagtgtatcgaaagtaaggatcgggtttcgtttttttgtggtttaagttagtttttagcggggttttcgggaatttttattttgggcgatggcgagggggagggagagtagtagagtcggcgtttttcgtagcgttgtttatttcgtcgtttgggttattgggtttttcgggcgttagtattttaaatcgatcggggcgtgggaggcgttttggaagttttaggtcggtcgggcgtattttgttgtaggtattttttcgagttcgttttttaggcgtagttggacgcggatttcgttttattttagtttttatttcgtcgttcgtagtgtttggggggcgcggggtttagtttaggtttagatttgggggtagtagcgggtatcgttttcgttattttcggggcgcgtcgggcgcggacgtagagaggagagcgcggcggtcgggatttatttgtttgcggtgcgtttgcgtggttgcgttagggagtatcggtcgggcggcgggattaagttgagttttgtttaggttgcgtttttcgtcggttcgttaatttgtcgggtattttcgcgttttgtcgttttcgtttttgggtagttgttgttgagtttcgggcgcgggtagtgtttcgtttcgtttcgcgaatttatttcgggtttcgtattgatttggtaattgtagattcgggttgagtttcgggttaggtttagggtttttagggagatgttagacggcgcggtgttttagattggttattggtttttttggtaatttggaatggtaaaattgttatttgataatttcgtatttttcgttgtagtgtttagttgggttttgggagagggtggggtgtttttttattttggtttttcggggttgtatataaatgagggcgtagtgtggtcgatttatagttttaggtttttttttcgtttgtttatatttttggcgagggtggttttcgttttagaatatagtcgttgtttttaggatttagatattttttttagatgtgtttgtaggcgggaattttttagttattttgtgttttttttatttttaaattttgtatttgtttcgttttagtttttttaagtcgttttttagttattttaggggtagcggcgtggtcgtttgttttatttttttttattattattttgatcgtcgatttgtggttttgaatcgttttcgattttataaagaattttattttagaatttttatttttatatattttttgtttttttttatggaatgtttttcgtttggtaatttttgttttttaaaatttttgtttttgaaatttttagtatcgttttttttggaaagtttgttttgatttttttttttaggtggggttttagggtgtaaatagttttttggttgattttgtttatgattttgttatggattgttaggggtttggtttaggtttggttgtttatcgtatagaaagtttattattgagatagcgagtattgttagggaagattttatttcggtgatattagttagtgagttgttgagaggggagataaatttttaatttatttttttttttgattaaagttaggggtttatatagtagggaaggaaaataggagggataaggaagaggaattggttaataggtagtaggtgtattgatgtaagtgttttaagttttagttttatgagtatttggttttttggaaaatttagcgggttttaattttgatgtttgatttttattcgaattagtttatttaggaattttttttttgtttttttattgtttattttattttattttattttttgatatggagttttgttttgttattcgggttggagtgtagtagtgcgattttagtttattgtaatttttgtttttttagtttaagcgatttttttgttttagttttttaagtagagacggggttttattatgttggttaggttggtttcgagtttttgattttaggcgatttattcgttttggttttttaaagtgttgggattataggcgggagttattgcgttaagtagagttttgtatttttaataaataaagtagtatttgttgatgaattagaattttgatttttttttttttttttttttttgggttgaattttatttttaataagttaaaaaaagatatttatgtgttaacgtttttttttttttttttttgtattttttttttttttttgatttttgaagttttaatatgaagtcgaaatattattatatataagtattttattatttgtatttgttgagtattttattattttatatttttaaaatttaaagtatggatggggaaaatgtgaatgggtagatcgttttatatttttttttttaaaaatgaaattgttaggttaggtacggtggtttatatttgtaattttaatattttgagaggttaaggtaggtagattatttgagtttaagagttcgagattagtttgggtaatatggtaaaattttgtttttataaaaaatataaaaattagtttggcgtggtgatatatatttatagttttatttatttgggaggttgaggtgggagaattgtttgaatttaggaggtatattatcgtattttagtttgggcgtagaagtgagattttattttaaaataataataataaaatgaaattgttattttaaaagtggttttttataaaatgggaattttttttattggaggttagttatgtttaatagaaaaatattttatgttggtcgtatttggagtaatagttaagaagagtttttttttgttattaaatattttttatttattttgagggatcgtgagattttagaattttgttttttgttttttttttattgtttattttgtttaggtgaggttttttttttagagtttttgaattttaagaagtagtacgggttgcgtgtagagaaggggtttgtatttggttttgttgtattttagttaagtggttttaagtaggattttaaattttattttttcgtttttaaaagggggatgatgttattaagtcggtagtattgatatggggttttcgggatagaggttatgtaggggtttagtttggtttagattttgattttttttaattgaaagaatttgagttaagaattatttggggttagagatatggtttaggagaaaggaaggatagagagtagtattttagtgtttttaggatttgggattttttggttttttagtgttattttgggggtggaagggtaagtagaggggaagtgaagttatattcggtttttgtgtgagtatttttatttttttttgatgggttaggaggcggtggggatagggaggtttgttcgggttttttattttttatagtgagatggtttttttttttattttttttggttggaatattatagattgagggtgtggtaggaggtatttttttttgattcgagtagaagttacgttgtgtgagcgagtgtagagtggggtggttggggtggggagtaggggggaggagggaagtcgtgttattaaagggaattgaatgaaatttatgaggttattggtagtttgaataatgtattttgtttatggattagttttttttagtgtagtttggttgatgataattgttttgttttttaaatttttattttagaaatttaattttttcggtttggttttttagggtttttagttgattgttttattttttagaaatttcgagtttttgagaatttgttggttggatattaggttttgaggttaataggtttgagttaaatttttattttgtaatttagaattgcgtgatttaagtaagttatttatttttttagaagttttattttttatttgtaaaggagaatggtgatattagtgttacgaattggttgtgagtttatatttaataatgtttatcgggtatgttgtatttgttaggataaagtggtggataatttttattttgtttaaaaatttttgtttttttggagtttttattttgtagagtaagatagacgataaatttttaagtaatgaaatcgggtgaggttttgaggggtattttataggttatggttttgttagggatagttattgaaaggtttagatttgaggtatgatatagtttgatttagattttaatattttttggtcgggtggggtggtttacgtttgtaattttagtattttgggaggttgaggtaggtggatgatttgaggttaggagatcgagattagtttggttaatatggggaaatttcgtttttattaaaaaaaaaaaaatataaaagttagttaggcgtggtggtttatatttgtaattttagttattcgggaagttgaggtaggaaaattgtttgaatttagaaggcggaggttgtagtgagtcgagattgtattattgtattttagtttgggtgatagagcgatatttcgttttaaaagaaaaaagaaaaaataaaaaaatatttttggttttcgtatttgaagtgtttatttgttttgaagtttttggtatatagaagtagtatttttttttttaggattaatgtttagggcgttatagttgggtttttttttttattttttattaatatcggtttagagttttttggggtgtgatttggaagttttttatttagttagtattgttatatggatatttttatattcggagtttttattttttttaatttatggttttgtttttatatggtttgtggaggaagttgttcgggtttttgttttaggtttcgataggttatttgttttttttgatgtttgtaatttggtttttgtttttgtcggtggaatttgttttggttttattttgttttttaggttttggatttatagtttaagtaagttttgaaatttacgggaatttttttaaaattttagtttttatttattttttttatttaaatttttagattttgggattttatttttttttagattttttattattttttttaaataaacgtgttgaagtttttttattttttttcgggattttttttttagtttagtattttgagtttgcgtttttgtgtttttgtttttcgcgggtttttaggatatcggtttagagtttttttttttttttattggttgtacgtggtttgatttagtgtttttaaaatttgtttagtttagtattgtgtttaaattatttttttttttgtttttgggttttgttacggaaggggtgggatatttattttttttgtatgtttcgagggttcgttgtggagtatgaggtatttggataaggaggaaagggaaaaggataaagtttagttggagattttagttttttagggttattgttttgtggggatagatgttaatttagttttataggtattagttaaagattttcggtatgtatttttgttttagaatgagttttgttgaagtttagtatttgtagatgttttagttaggtttacgaggtttattcgtttttgatgtggggtaaagggggttattagttttagattttgaagtatttttgaattagatttattttaagtttttgtagtttagaattaa

SEQ ID NO: 83 - DNA, 5921 bp, Artificial Sequence
  chemically treated genomic DNA (Homo sapiens)
aaattaattttttttattttgagcggtgagggagtaaattttgaatatatagggaggagcgtgggttttagagttaggcggttttaggggtttggggaggtgggttggggttttggagtttttaagggatgttgatatttttgttttgtttatagttattattgggtttatataggttgtttgtaaatttttttggtattaaggtatttggggttattaaatagtatatgggaggtagaaatgtagatttcgggagtttttattttttaaatgtttgtttattcgttaagataagttttgtgtaaatgggatttagtatttttgggttattggatttatttattagtaagggatttataggggtgttattgattgtgatgttgggataagggattgttttaggtaggtagggacgttcggttattagcgggattgggtttttttttagttaattttgtttttgatggggagttagaggggttaggttggggttatttattttagttttacgacgtgttttttttttcgttatttttgaagttattttttttcgttttgcgtttcggatttatttacgttgaggacggagatcgcggtattaattagtttattatttatagtatttttaggggtgagtggggtttagtttttaataatgttttgtattttttttgtttttgtttttatttttattttgggtagagttggttgggtttttgggttttagggggtcggggttgagtatttttattatttttttaggaaacgtgaatggtatatttattatttatttagattcgggtaattttatcgtggttaggagtgtttttagttttatgattttttttttgttggtgaaggtgaggtgggtatttgtatggggggtagggtagagggggaagggtggaaggtagggcggggggttagggttggggggtcggggtagggttttcgttaagtttgtatttgttttttttgagttttagtttttagcgttagttttatttttaattttattagttattgttgtttttttcgtttttagggttaataggtcgattttgttcgttatttagtgatttaggttatcgtggaggttgtggttgcggtcgggagttcgtttcgttttttttagagattgtatcgtggtatcgtggcgcgtggcgttggagcgggcgttgtggttaaggatgtagttgtttttttttagtttttgaggatttaggtttaggattcggagttttcggtagagagtgtatttaaggttttttttttgtgggtgggttagggttgtacgtgggaggtagtttggtcggggatttaatgagattttgtttaggattttaattcggttattatatatcgaattattaattatttatattttcggatggagggagaggttgtgttgattattattatattggtataggcgggagttttttacgtagaggtgcggggtagggtaggcgggtatttttaagggtgtggggtttaaagatgtgtttaggagggataagtttttttttgttttaggttgaggtttataatacggtgatttttggtatcgtaattatagttattgagatataagttttcgaataggagtttttttttataggtaagtttttttttataggtgagtttttagggttttttaaataagttttttcggtggtttttttttcgcggtaggtgtgtaaggggcgggtagaggtaagtttaagtattgttttcggtttttagatgtttttttatttttagaggttggaggaataattgggttttggattagtattattttcgaggtttttagattttttgagtttttttagggattttttacgattagttttgggggaggtataggtttttatttattttttggtataattttgaggttattaatttcgtttatattcggggggttttcgggtgtagaaaatagtattttttattaattagttattttcggtggggatatagtatagattttaaagttaggaattttttagtcgatgtttttcggtgtgggaattagtattttttattaattagttatatttagtgggggtatagtatagattttagagttaggaattttttagtcgatgttttttagtatgggaattagtattttttattaattagttatattcggtgggggtatagtatagattttagaggtaggaattttttagtcgatgtttttcggtatgggaattagtattttttattaattaattatattcggtgggggtatagtatagattttagagttaggaattttttagtcgatgttttttagtaagagtattttatttttaggtagtatttattttgttgttttttttttttgatttcggttattggttggtatgggaaacgttgtaggaagggtttattttaggttgatttggtttgattatgaaattttaaagaggagtttgtttgggattgatagatatagataggtttaaggtttttagtgaggtaatttgtgatgtgtgtaggatagaggttagatgtggggtttagcgaattttacgatttttacggttgtcgtttattttgtaagtttttgtattttttgtgagtttttgtgagtagtttggtttttcgggggggagggggtgggtagggtttcgatgggatatataggttttttgagttagggttagtagagtttgagatttgggagatagtttaggtttgggtggaatttaagtgttttaagtttggtataggttggtatgggaaatgtttggggtatttaatagtgcggggatgatgacgttttttattgcgatgttaggtggcggtttttcggaggataagcgtttttcggtggtggatatggcggttttgggcggggtgttgggtgcgttgttgttgttggttttttttggtttcgtcgtttttgtttataagtattatggttttcggtttaagtgttgttgtggtaaagtttcggtgaggtttaggatggagaatagggtaggcgattaggtaggaagtgggggacgggggataggagaggggagggtagagggatagatgtggagacggaggggtgtttagcgtggaatgagggtgtgtagggttaaggttgtagagatttagggatttcgttgacgtttcgattttcgtttgtaggagttttagttttaaggttttgataattaggcgtttttttttgattataaggttaattgggcgttcgtttttagttttacgtacgattttaagttcgcggaggtatcgatgttcgtagagttcgtatttttcggttttgttttttttaggcggtgtttttgagtttttcgtagcggttcgagttggcggaagttttacggcggtgaggtttattttgattaaggagcggcggtcggagggcgggtataaggttgtttggtttggcgaggatatcgggacggaggtagacgtggtcgtttttaacgcgtttattttggacgtggatggcgttagtgatttcggtagcggcgatgagggcgagggcgcggggaggggtgggggtttttacgatgcgttcggtggtgatgatttttatatttaagtggtttttttatttttttttttagtcgtacgggtattggaggtttcgtttttttagttttcgattcgaggtagaataaagtaaggttttcgaaatttaggttatggcgtggggtaggcgcgcgggtttatgggggttttatttatttagttttttgtcgttattagcgtttgagtttaggtgtgtagatgaggcggtgggtttggttacgttgtttttattttaaggttgtagtatttttcgtaaattatttgtagtgttcgtcgttttttcgaggttttgtgttagttagtttgggaagtttttttttcgttttaattatagttcgaggggggtttttttttttcgatttgtatcggagattttaggtattcggtttattttagatttttcgttttcgattttatatagagattgtttggggaggttgaggagtcgatgtaaatttttaaggcgacgtatttgggagtcggtggttttaaatatttgtcgggggttttagtttttttttgaaatttatatgtttgggttggagcgtagtagtaaatattttgtttagtgatttggattgaggcgcgttgggggtgggtgcgtcgtgtggtttgagtaggagttagattaggaggtttaggggtgagagatatatttttttcgttgtttttaaagttagagtttaggttgggcgtttatgtttagaattattaagggattttttgcggtttgttagtattttttttaatggaaatatattattaatttttttttaaatgttttaattgtgagagtatttgatatttttgattgaataatgtaaaaaatttaaagggggttgcgtacggcggttttcgtttaaattttagtattttgggaggtcgaggtgggtagattatttgaggtcgggagttcgatattagtttgattaatatagagaaatttcgtttttattaaaaatataaaattagtcgggcgtggtggtttatgtttgtaattttagttattcgggaggtttaggtaggagaattatttgaattcgggaggcggaggttgtggtgggttaagattgtgttatcgtattttagtttgggtaataaaagcgaaattttattttaaaaaaagaaacgtaaacggtgtagttgtttttttttcgaggtacgtttattttttattatttatttttttttttttttgagattgagttttgttttgttttttgggttgtagtggagtggttttatttcggtttattgtagttatttttaacgttttttatttttttttatttcgcgttggtcggggcggggtttcgttggtcgtatttaataataagaataggcggcgcgcgtttttttcggaaattttcgtttggttattataaaagcgtcggtttttcgttttttcgcgagacgaaatttttcgtttcggcggttttggtatttaggtattggggattttagatttacgcggtgtaggtcgggagcgagagttttcgtgggggtttcgtgatttcggaggggtagagttaagagttgggggagtttgagagatgagggtcgggcggggagggaggcggaggcggaggcggggtttcgcggagttgagaatcggacggggtgggatcgaggagggtgcgaagcgttattgtttaggtttcgttttttcgggagtttgattcgtttttgacgtcgtttttttcgttttcgtagggttcggtttgcgttttttcgttaggtttggatattggtttaatatttgtgattttatgtgtgcgcgtcggttatatttgtagttatatttgtagttttttttgttaagagatttatatcgaggtagcgtcggtggttataagtttttagtttatatttgtggatatttgtgatatttggttatacgatttgtggtcgcggtttggcgtttgttgcgataggagtttttattttttttgttataatatttgatcgttatttaattgtttttgtagaaggagtaatggttttggtttttgagaggtaagagttcggtttattttttttagatgttagttttcgagcgttttgtagtcggttttgatttttcgcggtcgggtattcgtagggtagttttacgcgtgttgttcggagagtggttttttggagagattagtagcggttgttatgaggggttgtagtggttggacgaggttcgtatttgttttcgcgtgttttggaagtatttcgcgcgtaaggatttgagcgaggtcgacgcgcgtatttttaaggtggggattttagtttcgtttcgtttcgggtgggagagttcgtttaggatttcgcgggttcggtatacgtgttttgtttttttttttagg

SEQ ID NO: 84 - DNA, 5921 bp, Artificial Sequence
  chemically treated genomic DNA (Homo sapiens)
tttgaagagggggatagaatacgtgtgtcgggttcgcggggttttaggcgggtttttttattcggggcggggcggggttggggtttttattttgaagatgcgcgcgtcggtttcgtttaggtttttgcgcgcgaagtgtttttagggtacgcggaaataggtgcgggtttcgtttagttattgtagttttttatagtagtcgttgttgatttttttaaggagttatttttcgaatagtacgcgtggggttgttttgcgggtgttcggtcgcggagagttagggtcggttgtagggcgttcggggattggtatttggagagggtgggtcgggtttttattttttaggagttaaggttattgttttttttgtaggggtagttaggtggcggttaggtgttataataggggaggtaagggtttttgtcgtagtagacgttaggtcgcggttataggtcgtgtggttaggtgttataggtgtttataggtgtggattgagggtttgtagttatcgacgttgtttcggtatggattttttggtagagggggttataggtgtgattgtaggtgtggtcggcgcgtatatatgaagttataggtgttgaattagtgtttaggtttggcgggaaggcgtaggtcggattttgcggagacgggaaaggcgacgttaggggcgggttaggttttcgggaaagcgaaatttaaatagtggcgtttcgtatttttttcgattttatttcgttcggtttttagtttcgcggaatttcgttttcgttttcgttttttttttcgttcgatttttattttttaggtttttttagtttttggttttattttttcggggttacggagtttttacggaggttttcgttttcggtttgtatcgcgtgggtttggggtttttagtatttgggtgttagagtcgtcgggacgggaagtttcgtttcgcggggaagcggagggtcggcgtttttatggtggttaggcgggagttttcgggaagggcgcgcgtcgtttgtttttattattggatgcgattagcggaatttcgtttcggttagcgcggagtagggaggagtggagggcgttgggagtggttgtagtgagtcgagatggagttattttattatagtttaggggatagagtaagatttagttttaaaaaaaaaaggaagtgggtaatgggaggtggacgtgtttcgaaaaaggggtagttgtatcgtttgcgtttttttttttgagatggagtttcgtttttgttatttaggttggagtgcggtggtataattttggtttattataattttcgtttttcgggtttaagtgatttttttatttaagtttttcgagtagttgggattataggtatgaattattacgttcggttaattttgtatttttagtagagacggggtttttttatgttggttaggttggtgtcgaattttcgattttaggtgatttgtttatttcggttttttaaagtgttgggatttaggcgagagtcgtcgtgcgtagttttttttgggttttttatattgtttagttaagaatattagatatttttataattaaaatatttggaaaggaattaatggtgtatttttattagggaaagtgttgataagtcgtaagggattttttgatggttttgggtatgggcgtttagtttgggttttggttttgggagtagcgaggggaatgtgttttttatttttaggttttttggtttggtttttgtttaggttatacggcgtatttatttttagcgcgttttagtttaggttattgggtagggtgtttattgttgcgttttaatttaagtatgtagattttagaaggggattaggattttcggtaggtgtttgagattatcggtttttaagtgcgtcgttttgggggtttgtatcggttttttagtttttttaggtaatttttgtgtagggtcgggagcgggaggtttgagatgagtcgggtgtttgagattttcggtgtaggtcgggggaggggagtttttttcgggttgtggttagagcgggagaggaattttttagattagttggtatagagtttcgggaaggcggcgggtattgtaggtggtttacgggaagtgttgtagttttggggtggggatagcgtggttagatttatcgttttatttgtatatttgggtttaagcgttaatgacgataggggattgagtgaatgggatttttatggattcgcgcgtttgttttacgttatggtttgggtttcgggagttttgttttattttgtttcgggtcggaggttgggggagcgagatttttagtgttcgtgcggttgggggagagggtggaggggttatttagatgtaggagttattattatcgggcgtatcgtagggatttttattttttttcgcgttttcgtttttatcgtcgttgtcggagttattggcgttatttacgtttagggtgggcgcgttgagaacgattacgtttgttttcgtttcgatgttttcgttaaattagatagttttgtattcgtttttcggtcgtcgttttttggttaggatggattttatcgtcgtggggttttcgttagttcgggtcgttgcggggggtttaggggtatcgtttggggagggtagggtcggggggtgcgggttttgcgggtatcggtgttttcgcgggtttggggtcgtgcgtggggttggggacgggcgtttagttggttttgtggttagggaggaacgtttggttgttaaagttttggggttggggtttttgtaggcgggagtcgaggcgttagcggggtttttgggtttttgtagttttggttttgtatatttttattttacgttggatattttttcgtttttatatttgtttttttgttttttttttttttgtttttcgttttttattttttgtttggtcgtttgttttgttttttattttgggttttatcggagttttgttatagtagtatttgagtcgggggttatagtgtttgtggataaggacggcgaggttaaggagagttagtagtagtagcgtatttagtatttcgtttagggtcgttatatttattatcgagaagcgtttgtttttcgaggggtcgttatttggtatcgtagtggaaaacgttattattttcgtattgttgagtgttttaggtattttttatgttaatttgtgttaggtttgggatatttgggttttatttaggtttgggttgttttttaaattttaggttttgttgattttggtttaaggggtttgtgtgttttatcgagattttgtttattttttttttttcgggaggttaagttgtttataggagtttataagaggtgtagggatttgtagggtgagcggtagtcgtgggaatcgtgggattcgttggattttatatttggtttttgttttatatatattataggttattttattgggggttttgggtttgtttgtgtttgttagttttaaatagatttttttttgggattttatggttaggttaggttagtttggggtggattttttttatagcgttttttatattagttaatgatcggagttagggagggaaggtaatagagtgggtgttatttgaagatggggtgtttttgttgaggggtatcggttgagaggtttttggttttggggtttgtgttgtgtttttatcgggtgtggttggttggtgggaggtgttggtttttatatcggggggtatcggttgagaggtttttgtttttggggtttgtgttgtgtttttatcgggtgtggttggttggtgggaggtgttggtttttatattggggggtatcggttgagaggtttttggttttggggtttgtgttgtgtttttattgggtgtggttggttggtgggaggtgttggtttttatatcggggggtatcggttgagaggtttttggttttggggtttgtgttgtgtttttatcgggagtggttggttggtgggaggtgttgttttttgtattcgggggtttttcgggtgtggacgaggttggtggttttagagttgtgttagagggtggatgagggtttgtgttttttttagagttggtcgtggagggtttttgggagggtttagggggtttggggatttcggaagtggtgttggtttagggtttagttgtttttttagtttttggggatggggggatatttgggggtcgggaatagtgtttgggtttgtttttgttcgttttttgtatatttatcgcgggaaaggagttatcgaaggggtttatttggagaattttgggggtttatttgtggaggggggtttatttgtggaggggggtttttgttcggaaatttgtattttaatgattgtggttgcggtgttagaggttatcgtgttgtgggttttaatttggggtaggaaggggtttgttttttttagatatatttttaagttttatatttttggagatgttcgtttgttttgtttcgtatttttgcgtagaaggttttcgtttgtgttagtgtggtggtggttagtataatttttttttttattcggaagtgtgagtggttggtaattcgatatgtgatggtcgagttgaggttttggatagggttttattgagttttcggttaggttgttttttacgtatagttttgatttatttatagaggggaggttttggatgtattttttatcgagaatttcgggttttgagtttggatttttagaggttgagaaggggtagttgtatttttgattataacgttcgttttagcgttacgcgttacggtgttacgatatagtttttgggggaagcggggcgggttttcggtcgtagttatagtttttacggtgatttgggttattgagtagcgggtaaggtcggtttgttggttttggaggcgggggaggtagtagtgattagtggggttgaaggtggagttggcgttgaaggttggggtttaggaaaggtaggtgtagatttggcgggggttttgtttcggttttttagttttgatttttcgttttattttttatttttttttttttgttttgttttttatgtaggtgtttattttatttttattagtagaaggaaggttatggggttggggatatttttggttacggtgaggttgttcgagtttgggtggatgatgaatgtattatttacgttttttgggaggatgatggaagtgtttagtttcggttttttgaggtttagggatttagttagttttgtttaaggtggggatggagatagggatagagggggtatagggtattgttgagggttgggttttatttatttttaaagatgttgtagatgatgggttggttgatgtcgcggttttcgtttttagcgtagatgggttcgggacgtaggacgaggggagatggttttagggatggcggaagggagggtacgtcgtggggttggggtggatggttttagtttggtttttttgattttttattaagggtagggttggttgaggaggggtttagtttcgttggtggtcgggcgtttttgtttgtttaggatagttttttgttttagtattataattagtaatatttttgtgggttttttattaatgaatgagtttagtggtttaaagatattgagttttatttgtataaggtttgttttgacgggtaagtaaatatttaggaagtgggggttttcggggtttgtatttttgttttttatgtattgtttggtggttttaggtgttttggtgttaggaaggtttgtagatagtttgtgtgggtttagtggtgattgtgagtagggtagagatgttagtattttttaagagttttagggttttagtttatttttttaggtttttgagatcgtttggttttggggtttacgtttttttttgtgtgtttagggtttgtttttttatcgtttaagatgggaagggttggttt

SEQ ID NO: 85 - DNA, 9254 bp, Artificial Sequence
  chemically treated genomic DNA (Homo sapiens)
tgggggaaattgattttatgatttaattatttttatttgattttatttttgatatgtgaggattattataatttaaggtgagatttgagtggggatataattaaattatatgagtggatatgtaatatgagtgagaaataattttgtgattgtaatttagtaagatttttggatggttaatatagtataatttagagtatatggaggtgtgtatttttagttttttgattttcgggtatttagtaggattgtatttttttgtattttttaagtaaggtatggttatgtgattaattttagttaataatatgtaaatataataaaaagtgttatttttaggagggagtttttaaagttaatgtgagtttattatgtttttttttttttgttaaattgatgcgatgattgttgaagtatgtattaagatgaaattttttttagattaggtttttaaatgagtatattaagtagagtttcgtgaagttgaatatgtagtatgagtaaaatataaaatttatttttaagttattgaaattttaggattgtttgttatggtagtataatttaaattattttgatttatataaaaattggtttttagatatgggttagtgtaataataataataagtataataataataaaattaaataattatttagagggcgataattaagaatattgttattagaagttgaagggatggtgatttgtttggtaaatatattatttgtgataatgtagaaggtagattatgaatttgatgaattaaagaaaaggattgtaaaatagagagtgagtagtgtgtgttggtggttgttggatgtattttgaaagttattataagttatttaaagatgaatttagaaaaatttggtttgtttgtaattaggaatgaaatggaatagagaaaatttataaatttagggatttatatcgttagaagaggtaattgttttttagtttcgattggtaaaatataaaattaagaaatatttttagtaagaaaggatttggaagaaattaagttttgaagtaaggattaagttataaagtatgaatttattattaaaattttaggataggaggtcgaggaggacggattatttgaggtcgggagttcgagataagtttgattaatatggagaaattttgtcgtttttaaaaatataaaattagtcgggcgtggtggcgtatgtttgtaattttagttatttaggaggttgaggtaggagaatcgtttgaattcgggaggtagaggttgtagtgagtcgagattgtgttattgtattttaattagggtaataagagtgaaatttcgttttagaaaaaaaaaaaaaaggattaattaagattttatttagtatatatttttaattggataaaatggttttgggaaaaggaagaaaggtttaatttttttattaaaatttaataagtttaaagtgtttaaaattaagtgaagagtaagagagtgagacggtaaaagagagatagaggagttaataggtaggagagtaggaaagtaaagagatatggtaaattaaagaagtatgtttggaaaagaattttgtggttattgttatatggaatattttatattagatagataagaagtttatttatatatatttaagatttaatgttattttgtatttttttaatttttaaaagtttatttaaaagtatattttttaatgtttgttttagttgtggaaaaggaagatttttcgagggtaaatttaggagttatggaaaataatgggtagggtagtttggtgttgtgattggatgggtttttaaggttgttttttttgaataaagaatgagggaattttattaggggaaggagagtagattaaatatttggtgaatagaaagggagatagagtttttagtgttattttttaaatatttttggagagttttttgagatatttggtaggattatagtgatttaaagaggtatggttatgtgattgttttggttaatgatgtatgggtagaagtgatgtgtgttataagtggatgttttgatagttatgatgtttcgagttttttttttatagttaggatagttgtgaaaaggggtattaatacgaggttttttttagtttgagttttttagtgattataatgagtagagttattttgttaatttataacggttatgtagtagaaatgattaatttttattggaataagttattgatatgttagggttgtttgttagggtagtataatattgttttttttgatagaattgggagtgagagataaggttggagagagaaggagttggattgtgaaaagttttttttttaaggtataggaatcggaatttttttgattgtaaggaaaagttaatgaaggtttttaagtaggggcgttaatatgaatagatttgttatttttttggatgaaatatgttattttttaatataaggagaagattagtttattaaattatatgaggtagagaggaatatatagaattttaggtaaaagatatatatttatgtaaagttttaagttttgaaatttttaaatataagagttttgaacggagttatagttagaggattaggtaagaaaattttttttatgttataagcgttattttttttgtagataattaatattttataagaaagtttgttagagtagagaaaatataaaggaatgtaatatagatttgaggttaatttttagttgtttgtgtgattttaataaagatatttaatttttttgggtttatttttttatatgttaaatttggataataatatatgttttttaagatagttgtggggagaaaatagcgtatttaaattgtttaggagaatgtttggtagataataagtgtttaatatatgaaattgatttttattattgttattaaaaaatatttagaatattaattttttgaatataatagaaaatgatttagggtaatagatagaggagaatgttttttttttgaggaagtaattggattttgttattattgtatatttatttattttattttttttttagtttagtgtttggtttatagtaggtttttagttattttttgtagattagtgaaagttaggtgagtgttcggagtgaagaaaagttggtaggttttttattgatattagttgttgttggtttttgaatatttaaagtcgtaaatattttagggttgggggtaatgaatttaaggttgaattttaagtttagaagtagcgaagtttgaatttagaatttaggaatttaaattgttgtaggtttaattttaagttttagttttagatagaggtttgggaaagatttgatttttaattcggtttttttttttttttttttttcgatgttttttataggaaagtatatttggttttgttaaatcgtatttttatattttggtattttatttaggttttgcgaggatggaaattgcgaggtaggggagggaagcgggttgtttggttattatttttttagtgttgtaggcgattttgttatattaatttttggtagtttagtgaggtggacggtatcggttttatttgtagatgagggaaatgaagttcggaggagtttcgtgatttgtttgttttatattgtggtagtttggttacgaaagaattaggattttcgatttcgggattttttttattatatattttcgtttttaaggggtggggggcggggggagaataaaataatcgcggaaaaggaattatttatatgtgtttagcgttttttagaggttatttaggatatgcgtttattattcggtcgggagtgtagagatttgaagtttaggttttatttcgggtttcgagtattattgcgtgattttatgcgagtgttcgtcgttttttgggtttgttttttcggaagtaattcggcgcggatggagtgtgtgtgtgcgcgcgcgcgcgcgttatgttgtgcgtgttgtgttaagcgtgtgcgtgttgttcgggggcgggagggggagtagattaatatcggggtttttcgagtttcggatcgtttatacgtttgtttttatttggattttgttatttattaattgcgtttattataaaaattgttttttcgaggtaaagttgtgaattttcgcgtttttttttttacggtttcggaggatgaagtggggtgtaacggagatttagttgagcgtttagtttcgggtaatataaatttttcggtttttacgagtagttagacgatttcgcggatcgtcgtttttgaatttgatcgagatgtaaatttcggagtgtttttaacgtggggggtcgattttcgggagatcgtttttaaatttaagtttttttaggttcgtttttatttgggattttatagagttattttaagggcggtattttcgttttttcggaagtgcgggggggtggtagcgtatttggatttttagtttttagtttcgcgcggtggcggtcgtcggtggatgatttcgggttttataagtggggaaataataattatttttcgttcgtatttttggtttaaaataattggttaggttttttggtttttcgggtttttgtatttttcgtattttcgttcgtagtcgtgaatttgagtttttttttattagaggttgcgagcgttcgttcgttcgcggtagttatcgttattagatagttaaattttaagacgttagtttataatgtatcgggcgggtcgggaaaaacggttcggggaggggatcggggaagagagggtcgagaggcgtgcggtaggggggagggtaggagaaagaagggttcgattgtaggagggtagcggagtattattttatttcgtgagttttcgcgggtttagagaagaattttttagggtggagtttttatggtgacgggcgggttcgtttttttgagagcgacgcgagttaatgggaaggttttggggtgatattatgggttatttttaggggttgattggtagtagataagtgttgagttcgggttggataagggtttagagttgtattgagtgtggttgaagtagcgaggcgggagtggaggtgcgcggagttaggtagatagatagatatagttagttagttaggtcggtagtatagttcgaattgtaaattttattttttttttattttttttttaattgtttagagttagcgtttgtggttttcgggttggtgtttcgggagtgtttagagagtttggtttttagtcgttttcgggaggagagttttgttgtttaggcgttgttgatagcggcggaaagtagcggtatttacgcgttcgtcgggggaagtcggcgagcggttgtagtagtaaagaattttttcggttgggaggatcggagataagtggtagagtttcggagttaatttttgtaagttttttttgcgttttaggtttttttacggcggtaaagattagaaggcggcggagagttacgtaagagaagaaggacgtgcgtttagtttcgttcgtatcggttgttgaatttgggcgagcgcgagtcgcggttgtcgggcgttttttttttttagtagcggaggaggggataagtcgtcggagttcgggcggttaagattcgtcgtcggtcggttattgtagggttcgtattgattcgtttcgcggggagagtcgttgttttgggaagtgagttcgtttgcggatttcgaggaatcgttgcgtacgaagagcgtttagtgagtgatcgcgattttttaaagtcgggtagcgcgcgcgagtcgataagtaagagtgcgggaggtattttaattaattttgcgttttttggagcgagttggtgaggagggcgtagcggggacgatagttagcgggtgcgtgcgtttttagagaaattttttttgttaaaggtttcggggggcgcgggtgtttttcgtttgttatagttttgttgcggtttcgaaatttgtgcgcgtagtttaaattaattttacgtgaagtgacggattgttttatgattgtaaagatggaaacgattttttatgacgatgtttttaacgtttcgtttttttcgttcgagagcggattttatggttatagtaattttaagattttgaaatagagtatgattttgaatttggtcgatttagtggggagtttgaagtcgtattttcgcgttaagaattcggatttttttatttcgttcgacgtggggttgtttaagttggcgtcgttcgagttggagcgtttgataatttagtttagtaacgggtatattattattacgtcgatttttatttagtttttgtgttttaagaacgtgatagatgagtaggagggtttcgtcgagggtttcgtgcgcgttttggtcgaattgtatagttagaatacgttgtttagcgttacgtcggcggcgtagtcggttaacggggtaggtatggtggttttcgcggtagtttcggtggtagggggtagcggtagcggcggttttagcgttagtttgtatagcgagtcgtcggtttacgtaaattttagtaattttaatttaggcgcgttgagtagcggcggcggggcgtttttttacggcgcggtcggtttggtttttttcgcgtaattttagtagtagtagtagtcgtcgtattatttgttttagtagatgttcgtgtagtattcgcggttgtaggttttgaaggaggagttttagatagtgttcgagatgttcggcgagatatcgtttttgttttttatcgatatggagttttaggagcggattaaggcggagaggaagcgtatgaggaatcgtatcgttgtttttaagtgtcgaaaaaggaagttggagagaatcgttcggttggaggaaaaagtgaaaattttgaaagtttagaattcggagttggcgtttacggttaatatgtttagggaataggtggtatagtttaaatagaaagttatgaattacgttaatagtgggtgttaatttatgttaacgtagtagttgtaaatattttgaagagagatcgtcgggggttgaggggtaacgaagaaaaaaaataatatagagagatagatttgagaatttgataagttgcgacggagagaaaaaagaagtgttcgagaattaaagttaagggtatttaagttggattgggttgcgttttgacggcgtttttagtgtgtacgagtgggaaggatttggcgcgtttttttttggcgtggagttagggagcggtcgtttgcgggttgtttcgttttgcggacgggttgttttcgcgcgaacggaacgttggatttttcgttaatattgattaagaattgtatggatttaatattcgattttatttagtattaaaggggggagggggagggggttataaattgtaatagagattgtagattgtttttgtagtattttttaagaatataaagcggggggagggttggggaggggcggtaggagggaggtttgtgagagcgaggttgagtttatagatgaattttttttggtttgttttcgttaattgtgtatgtatatatatatattttttaatttgatgaaagttgattattgttaataaatagttttatgtttttgtaagttattttttgtttgtttgtttgggtattttgtttagtgttgtttgtaaataagagatttggagtattttgagtttattatttgtaataaagtatataatttttttatgttttgtttttgaaaattttagaaaggatatttaagaaaatataataaattattggaaagtatttttttaattttttttttgtattatttgtagatattagttatttaggtggagttgaaagagttaagaatgtcgattaaaattatttttagtgttttttattattaagtagtaaaaattgttttttattagattttagaaataaatgtatttgatgtatttgatgttatggttaggttatatttttttttttttagttatttatatggaattgtttattaaaggatagtgcgatgttttaggaggttggaggaaggggggttgtagtggagagggatagtttattgagaagttaaatattttaaagtttggattgtattaagtggtatgtgttgtgattatttataatgttagtagaaattttataataggtgtttatttttaaagtaggaattggtggtagattttataaaagatgtatttttttaatttggaattttttttttgataatttttagataaaaagatggtttttgtttatgaatatttataatagtatttttgttataataaatgtatttaaatattaataatagattttgaattgtttttttttattatttttttttttttaagttatatattgaagtttttatttttagttgttgaggttaatattgttgtaatttgaagtgatttgaaaattaagaagtaaagaatttaggaagagttaaattagaagttgtgatttgaatgaaatagttttttaattttattaattttttttttttttttttatttttatttttttttttattattttatttttaaataaatttttatgtttatggaaattaatagtttagtattttgggtttgtttgtagtttattttttaatttgtttttaaaataattaattttgtttaaatatagaataagttttaaaagatagtaatttaatattatggaaaagatttataagagaaaatatgaattagtattaatttaatgattatatgcgtaaattaaattttagttttggggaaatgggaaatttgaattttatttatagatataatttaggagattaataaggtagtgtttaataagggaataattttttgtttggttgttttttatattaagagttagtgtgattattaggtagtaaaagtaatttgatatttaggaatattttataaattattaattgagttagggttgtttgtttattagtagtgttttagtatttagtaggtttgggagtgttaatattttgtttgtggttgtaaatttaaatatataaagagtttttttttaggagtatatttaggagtggaagagattggataggtttgttagtttcggattttttgtaataatattttttgaataaagggttattgggagtagagtttagtttgttaaattgaatttgtcgatgttagtaattcggaaggtgagatgattttgattatatgtagaaatagtagagggataataaagtattttggggtggggttttgtggaagttaaataagagttaattagaaaaaataagtaggttggggaattaattatttgtaaagg

SEQ ID NO: 86 - DNA, 9254 bp, Artificial Sequence
  chemically treated genomic DNA (Homo sapiens)
tttttgtaggtaattaattttttagtttgtttattttttttagttggtttttgtttagtttttatagagttttattttaaaatgttttattgtttttttgttatttttatatatggttaaaattattttatttttcgggttgttgatatcggtaaatttagtttggtaaattgggttttgtttttagtaattttttgtttaagaagtgttattataaaggattcgaagttaataagtttgtttaattttttttatttttagatatatttttaaggagaaattttttgtgtatttggatttatagttataggtaggatattagtatttttagatttattgggtattagaatattgttaatgagtaaatagttttgatttaattagtggtttgtgaaatatttttggatattaaattgtttttgttgtttgataattatattggtttttggtatgaaaagtaattaagtaaaaaattgtttttttgttaagtattgttttgttgattttttaagttatatttgtaggtagaatttaagttttttatttttttagagttgaggtttgatttacgtatgtaattattgagttagtattagtttatgtttttttttgtgaattttttttatagtattagattattattttttgagatttattttatatttaaataaggttgattattttagaaataaattaagaaataagttatagatagatttaaaatgttaaattgttagtttttataggtataggggtttatttgggggtgaggtagtagagagagagatagagatggagaaagagggaaagaattaatgaaattgggagattgttttatttagattataatttttagtttgattttttttaaattttttgttttttaatttttaaattattttagattgtagtaatgttaattttagtaattaaaaataaaaattttagtatataatttgggaagaaaaaagtagtaaagggaagtaatttaagatttgttattggtatttgaatatatttattgtgataagaatgttgttataaatatttataagtaaaggttatttttttatttaggaattgttaaagagaagattttaaattggaaggatatattttttgtaaaatttgttattaatttttgttttgagaataagtatttattgtaaaatttttattaatattataaatggttatagtatatgttatttgatataatttaaattttgaaatgtttgattttttagtgggttgtttttttttattgtaatttttttttttttagttttttgaaatatcgtattattttttggtaagtaattttatatagatagttgggggaggaggagtataatttgattatagtattaggtatattaggtatatttatttttaaagtttaatagagaatagtttttattgtttaatagtaagaagtattgagagtgattttaatcgatatttttaatttttttaattttatttagatagttagtatttatagatgatgtagaaaagaggttaggggagtattttttaatagtttattgtatttttttaaatattttttttggaatttttagaaataaaatataaaaaaattatatattttattataaatggtaaatttagagtgttttaaattttttatttataaataatattgggtaggatatttaaataaataaataagaaataatttataaaggtatgaagttgtttattgatagtaattagtttttattaaattaaaaaatatatatatgtatatatatagttaacgaaggtaggttagaaagagtttatttgtaggtttagtttcgtttttataaattttttttttgtcgtttttttttaatttttttttcgttttgtgtttttaaggagtattatagaagtaatttatagtttttattgtagtttgtaatttttttttttttttttttttaatattgaatgagatcgaatgttaggtttatgtagtttttggttaatgttaacgaaaagtttaacgtttcgttcgcgcggggatagttcgttcgtaaagcggggtagttcgtaggcggtcgttttttggttttacgttaagggagggcgcgttaagttttttttattcgtgtatattgggggcgtcgttaggacgtaatttagtttaatttggatatttttggttttagttttcggatatttttttttttttttcgtcgtaatttgttaagtttttaagtttgtttttttgtgttatttttttttttcgttgttttttagttttcgacggtttttttttaaaatgtttgtaattgttgcgttagtatgagttggtatttattgttaacgtggtttatgattttttgtttaagttgtgttatttgttttttgagtatgttggtcgtggacgttagtttcgagttttgagtttttaaggtttttatttttttttttagtcgggcgattttttttagttttttttttcggtatttggaggtagcgatgcggttttttatgcgtttttttttcgttttgattcgtttttgggattttatgtcgatgggggataggggcggtgtttcgtcgggtatttcgggtattgtttgaggttttttttttagggtttgtagtcgcgggtgttgtacgggtatttgttggggtaggtggtgcggcggttgttgttgttgttggggttgcgcgggaaaggttaggtcggtcgcgtcgtaggagggcgtttcgtcgtcgttgtttagcgcgtttgggttgaagttgttgaggtttgcgtagatcggcggttcgttgtgtaggttggcgttgaagtcgtcgttgtcgttgttttttgttatcgaggttatcgcgggagttattatgtttgtttcgttgatcggttgcgtcgtcgacgtgacgttgggtagcgtgttttggttgtgtagttcggttagggcgcgtacgaagttttcggcgaagtttttttgtttatttgttacgtttttggggtataggaattgggtgggggtcggcgtggtggtgatgtgttcgttgttggattggattattaggcgttttagttcgggcgacgttagtttgagtagttttacgtcgggcgaggtgaggaggttcgagtttttggcgcggaggtgcggttttaggttttttattgggtcggttaggtttagggttatgttttgttttaggattttggggttattgtagttataaggttcgttttcggacgggaggaacgaggcgttgagggtatcgttatagaaggtcgtttttatttttgtagttatagaatagttcgttattttacgtgaggttagtttgggttgcgcgtataagtttcggggtcgtaatagggttgtggtaagcgggggatattcgcgtttttcggagtttttgatagggaaagtttttttaagagcgtacgtattcgttggttgtcgttttcgttgcgttttttttattagttcgttttagggagcgtagggttaattaagatgtttttcgtatttttatttgtcgattcgcgcgcgttattcggttttgaaaagtcgcggttatttattgagcgtttttcgtgcgtagcggtttttcggagttcgtaggcgaatttattttttagagtagcggtttttttcgcggagcggattagtgcggattttgtagtggtcggtcggcggcgggttttggtcgttcggatttcgacgatttgttttttttttcgttgttagggggagggggcgttcggtagtcgcggttcgcgttcgtttaagtttaataatcggtgcgagcgaagttgagcgtacgtttttttttttttgcgtggtttttcgtcgttttttggtttttatcgtcgtggagaagtttaagacgtaggaaaggtttgtaaaagttggtttcgggattttgttatttgttttcggtttttttagtcgggaaagttttttgttgttgtagtcgttcgtcgatttttttcggcgggcgcgtgggtatcgttgtttttcgtcgttgttaatagcgtttgggtagtagggtttttttttcgggggcggttggagattaggttttttggatattttcgaaatattagttcgggagttataggcgttagttttgggtagttagagagaaggtgaaaagaaaataagatttgtagttcggattatattgtcgatttggttggttggttgtgtttgtttgtttgtttgatttcgcgtatttttattttcgtttcgttgttttagttatatttagtgtaattttgagtttttatttagttcgagtttaatatttatttgttattagttaatttttaaaaatagtttatgatgttattttaaggtttttttattggttcgcgtcgtttttaggggggcgggttcgttcgttattatggagattttattttagaagatttttttttgggttcgcggaggtttacgggatgaggtaatgtttcgttgtttttttatagtcgggttttttttttttttatttttttttttgtcgtacgtttttcggttttttttttttcggtttttttttcgggtcgtttttttcggttcgttcggtgtattgtgggttgacgttttggggtttgattgtttagtgacggtggttgtcgcgagcgggcggacgttcgtaatttttgatggaggggggtttaagtttacggttgcggacggggatgcgggggatgtagggattcgggaggttagggaatttggttagttgttttgggttaggggtgcgggcgaggggtggttgttgtttttttatttgtggggttcgaagttatttatcggcggtcgttatcgcgcggggttggaggttgagaatttaagtacgttgttattttttcgtattttcgggggggcgggaatatcgtttttaaggtggttttgtgaagttttaggtgggggcgagtttaaggggatttaagtttaggggcggtttttcgagagtcggttttttacgttgagaatatttcgaagtttgtatttcggttaagtttaggagcgacggttcgcggggtcgtttggttgttcgtagaagtcgagagatttgtattgttcgaaattggacgtttagttgagttttcgttgtattttattttatttttcgggatcgtgggggaaagggcgcgggggtttatagttttgtttcggaggggtagtttttatagtgggcgtaattggtgggtaatagggtttagatgggaataagcgtgtaggcgattcgaaattcggggaatttcggtgttagtttattttttttttcgttttcggataatacgtatacgtttaatataatacgtataatataacgcgcgcgcgcgcgtatatatatattttattcgcgtcgagttgttttcgggaaaataagtttagaaggcggcggatattcgtataaagttacgtagtagtattcggagttcggggtagaatttggattttaaatttttgtattttcggtcgggtggtgggcgtatattttgggtagtttttaggaagcgttagatatatgtaagtggtttttttttcgcggttattttatttttttttcgttttttattttttagggacgaaagtgtgtggtggaaagaatttcgaagtcgggaattttggttttttcgtggttaggttattatagtgtgaagtaagtaaattacggaattttttcgagttttattttttttatttgtaggtggggtcggtgtcgtttattttattgggttgttaggagttagtgtgatagggtcgtttgtagtattagggaggtggtggttaaatagttcgttttttttttttgtttcgtagtttttattttcgtagagtttggataggatgttaggatataagagtgcgatttggtaggattaggtgtatttttttgtgagaagtatcgaggggaggaggggagggggaatcgggttagaagttagattttttttaagtttttgtttaaaattggggtttgaagttggatttgtagtagtttaagtttttaggttttaaatttagatttcgttgtttttgaatttggaatttagttttgggtttattgtttttagttttaaggtatttgcggttttgagtgtttagaaattaatagtagttggtattagtgggaaatttgttaatttttttttatttcgggtatttatttagtttttattgatttgtagagggtaattgaaagtttattgtgagttaggtattgagttggggagggggtggggtaggtaggtatatagtgatgataagatttagttgtttttttaaggagagaatatttttttttgtttgttgttttgaattattttttgttgtatttagggagttggtgttttaaatattttttaataatagtaataaaaattagttttatgtattaaatatttattatttgttaggtatttttttaagtaatttaaatacgttgttttttttttataattgttttgagagatatatattattatttagatttaatatgtgaggaaataggtttagagaggttaagtatttttgttgaggttatataggtagttggaaattgattttaggtttgtgttatatttttttgtattttttttattttggtaaatttttttgtggagtattagttatttgtagaggaaatagcgtttgtggtatagaagaaatttttttgtttgattttttgattgtaatttcgtttagagtttttgtatttagaaattttaagatttaggattttgtataaatatatattttttgtttaaggttttgtgtgtttttttttgttttatgtggtttagtaggttgattttttttttatgttgagaaatagtatattttatttaaaaaaataataaatttgtttatgttaacgtttttgtttggaagtttttattggtttttttttataattaggagagtttcgatttttatgttttggagaaggggttttttataatttaattttttttttttttagttttattttttatttttagttttgttaggaaaggtagtgttatgttgttttaataaataattttaatatattagtggtttattttagtgaaagttggttatttttgttatatgatcgttgtaggttggtagggtagttttgtttattgtagttattaaagggtttaggttgaaggaggtttcgtgttgatatttttttttatagttattttgattgtggggaaggaattcggaatattatggttgttagagtatttatttatggtatatattatttttgtttatatattattggttaaagtagttatatggttatgtttttttagattattataattttattaggtgttttaaagggttttttaggaatatttggggaataatattaaagattttgtttttttttttgtttattaaatgtttggtttatttttttttttttggtggaatttttttattttttatttaagggaaataattttaaagatttatttagttatagtattaagttgttttgtttattgttttttatgatttttggatttgttttcggagagttttttttttttatagttaaagtaggtattggaaaatatgtttttaaataagtttttaaaagttggggagatgtagagtgatattaagttttgaatatgtgtaggtaggttttttatttatttgatatgaggtgttttatgtgataatagttataaagtttttttttagatatatttttttggtttgttatatttttttgtttttttgtttttttgtttgttgatttttttgttttttttttgtcgttttatttttttgttttttatttgattttgagtattttgggtttattgggttttgatgggagagttagatttttttttttttttttagagttattttgtttagttgaaagtatatattgggtaagattttaattgatttttttttttttttttttgagacggagttttatttttgttgttttggttggagtgtaatggtatagtttcggtttattgtaatttttatttttcgggtttaagcgatttttttgttttagttttttgagtagttgggattataggtatgcgttattacgttcggttaattttgtatttttaggagcgataggatttttttatattggttaggtttgtttcgaattttcgattttaggtgattcgtttttttcggttttttattttgaggttttaatagtaggtttatattttgtgatttgatttttattttaaagtttagttttttttaggtttttttttgttaaaagtattttttgattttatattttattagtcgggattgggaaataattgttttttttaacgatgtaaatttttggatttataggttttttttattttattttatttttgattgtaaataggttaaatttttttgagtttatttttgaatagtttgtagtaatttttagaatgtatttaatagttattaatatatattatttattttttgttttataatttttttttttagtttattaggtttatgatttgttttttatattattataggtgatatgtttattaaatagattattatttttttagtttttgatagtagtgtttttagttatcgttttttaaatgattgtttagttttattgttgttatgtttattgttgttattatattaatttatatttaggagttaatttttatatgagttaggatggtttaggttatgttgttataataaataattttaaaattttagtggtttaaaaataaattttatattttgtttatattatatgtttaattttacggggttttgtttaatgtgtttatttagaaatttagtttgaagaaggttttattttgatatatgttttaataattatcgtattagtttggtaggggaaagaaagtatggtgaatttatattggttttaaaagtttttttttaggaatgatattttttattgtatttatatattattggttaaaattagttatatggttatgttttatttaaagggtgtaggaaagtgtaattttattaggtattcggaagttaaagagttggaaatgtatatttttatatattttaggttatgttgtgttagttatttaaaaattttattgggttataattatagaattgttttttatttatattgtatgtttatttatatggtttggttgtgtttttatttaaattttattttgaattgtaataatttttatatgttaaaggtggggttaggtggagataattgaattatggggttagtttttttta

SEQ ID NO: 87 - DNA, 5928 bp, Artificial Sequence
  chemically treated genomic DNA (Homo sapiens)
gttgggataaatggaaggataggaatggggtgttttagagggttttttggttgggaggaggaaggagagggtaggaaagggtattgaggtggagtaatagaaaatgcgaagagaaagaaaaagggaggttaggcgtagtgatttaagtttgtaattttagtattttgggaggttgaggcgggtagattatgaggttaggtttaaggttagtttgattaatatcgtgaaatttcgtttttattaaaaatataaaaaattagtcgggcgtgttggtatatgtttgtaattttagttatttagggaggttgaggtaggagaatcgtttgaatttaggaggggaaggttgtagtgagttaagattaagttattgtattttagtttgggcgatagagcgagattttattttaaaaaaaagaagaaaggagtttttgggggtggtaaaggtagttttttatatttaggggttaggagaggttttttttatttagttttgaagattttttttttttttttatggaggagatagaataagatatagataagggatagataggttttagttagatggagaggattgacgacggttttaggggatatggttaggaagggttttttggagaaggtggtgggttttgaaggatgagtaggagttcgttaagagtgtaagggtattttaagttgagagaatttaaaattaaagaattgtagttatatttgggtaaataatataattatagaaagtatttattgattttttattatttgtttttttttttttttttttttttttttgagttggagttttattttgttgtttaggttggagtgtagtggcgcgatttcggtttattgtaattttttttttttgggtttaagtgatttttttgttttagttttttaagtagttgggattaaaggcgtgcgttattatatcgggagaatttttgtatttttagtagagataaggttttattatgttggttaggttggtttcgaacgtttgatttcgtgatttatttgttttagttttttaaagtgttgagattataggcgtgcgttattatatttagtttgattttttattatttttttaaatttaataaaaatcgtaatgttttttttttttgtattatcgtggtgtgtttttgattttatttttcgttatatttttttataagatttttaggattaagcgatttttggataagaaataaaagtaaaatcgttttattttttagtggatttggatgaaaattggaaataaaattaggtataattttaaaaggatattggagaagaattaagttgggtttataaggaattgtatatgagatggtatatatatttatgttgtttgaaggttacgattacgttagtatattaaattgaaagtgttattattatttggagagttcgacgtgtttttttttttgaatttgttatgaacgtgtgggttggttgggtttagtaataaatatgtgaggttttttattttaaaaaaaaaaatcgcgatattttataaagtaggtaggtttatttgtttaatttttatgaaggaaaagttgaggtttagagaggttgataggtttttgtattttatttgtttgtttgtaggaaagtgttttatttagtttaggttgttttagtttattatttattagattatttttttagttgttaaggttgaggtttaagtttagggtagggtttttgtaggtcgtttatttattttttgttttagggagaggtatgatttcgttttttttattttggttttattgtacgggatttagagaggggtttttagggtagggttggttataggtttgcgggttggattttgttttattagggatttttttgtttaggatagaatttgggttagagagtatagagatttatggatttgagtatgtatttgtgtgtatttgcgtttgtttatataatacgaatatagatagatataggtgtatatatagatatatattttaataggtagatagatatttttttaattaatttagagataaaataaatttatatttttagttttttgttttggtaatttgaattttaggtttgttaggttaggtttttattattattattattattattattattattattattattatttttaagatggagttttgttttgttgtttaggttggagtgtagtggtatgattttagtttattgtaatttttattttttgggtttaagtgatttttttttttttagagtagttgggattatcggtgcgttttttatgtttggttaatttttgtatttttagtagagatagggttttgttatattggttaggttggtttcgaatttttgattttagatgatttgttcgttttagttttttaaagtgtttattataggtgtgagttatttcgtttagtttattttttttttttttttttttttttttgagatagtgttttattttgtagtttaggttggagtgtaatggcgtaatttcggtttattgtaatttttatttttcgggtttaagcgatttttttgttttagtttttcgattagttgggattataggtatttgttattatatttggttaattttttttttttttttttttttttttttttttttgagacggagtttcgttttgttgtttaggttggagtgtagtggtgtgatttcggtttattgtaagttttgtttttcgggtttatgttatttttttgttttagtttttcgagtagttggggattataggcgttcgttattatgttcggttaatttttttttttattttttagtagagatagggttttatcgtgttaattaggatggttttgattttttgatttcgtgattagtttgttttggttttttaaagtgttgggatgataggcgtgagtttttgcgtttagtttaatttttatttttaatagagatggggttttattatgatggttaggttggttttaaatttttgattttaaatgtttgttttagatttttaaagtgttgggattataggtaggagttatcgcgtgtggtcgataggttattttttttggtgatgaggatagttttttttatggtttttatgttttagttgggggtagagttaggtgagtaaggaggatagaaaaggagtaacgtatgtttattggttaggtagataaattgaggttagagattatttatataagtaattttttgttgtatttatttttattttttatttttttttgagattggagttttattttgttttttaggttggagtgtagtggtataattttagtttattgtaatttttgtttttcgggtttaagcgatttttatgttttagttttttgagtagttgggattataggtgtatattattatattcggttaattttcgtatttttttttttttttgtatttttgtatttcggttagtttggttttgaattgttgattttaagtgatttgtttgtttcggttttttaaagtgttgggattataggtatgagttattatatttagtttcgtatttatttttaatattgagtatttattttatgcgaggttttgttagtaggtttagtataggtaatgtttttgatttttagggattatggtttattttattattttggtagatttagaggttataataaaggagtaaagtttgagggtggggtattttttgaagatatatttttgtattgggggaagggagtattaagtagagagtatagtacgtgtaaaggtttagaggtacgattagttttgtaattgggaggttaaggattagagagagtgaggggaaggaggttagggaaaggagggtgtgggttttatttagatagaggtggggagttggaggggtgtatgtagaggttgtaggttagatttagatgttttaaggattttttgtgagtattggtggggtgggtttatttttttttttttatattttttttttagttagttttaatagtggtttattaagttttaatagttatgatagtggtaataagtatgtaataattatattcggtatttttgttttattagtttagtttttggagttgggtattttcgtttaggatattatagttttggtagatttggggttaaaacgtgggcggcggaaggaaggggttgcgtaggggtttggatttttaggttttagggttttaagggtggataagagtttaggtttagttatagttcgggttttgttgtgatttttagttaattttcgggggatggttattttatttttttgagtttagttttttatttgtaaaggtaggaagtaggatttttggttttagaacgtatttagtgaaaatgattaggatttaagcgtttttagtaatttttggcgattttttttttttttttcgtttttttttgagtaattatacgcggggtggagggagggagggaaggaaggagggagggtgaggaacgtagatttttttatattttcggcgagttttcggatatagttttattaggtttttagtttcgtattcgtataaagtttttttagaaggcgcgttaggggaggttttggcggtatagtagagtaggaggcgttaaggagttatttagttatgcgggattttatttttttttagttttcggaggtcggtatcgttttcgttttcgttttcgttcggacggggttttacgcgcggatacggggcggggtttcggggcgggcgggcgtttggtggttcgggtttattacgttattcgggacgtgttttggcggaggcggcgtcggggagatcggtcgtatatagcggtttcggggcggggtgattcggttcgggcgcgcggtcgtttttatgacgttaatttataaggtagcgcgttgttgtggcgtttatcgcgcgtcgtcggggtaacggcggtcgggcgggcgtcggcggtttggtttcgtttttttatgtaaatgagcgacgttattcgtatttaatggcgaacggggcggtgagtttatcgcgtcgagtcgaggttataagagggcgtataagtggcgagtttcggcgagagtattatcgttgtcgtttatcgatatggataacgtaggagcgtattaaggcggagcgtaagcggttgcgtaatcgtatcgtacgtattataagtgtcgtaagcgtaagttggagcgtatttcgcgtttggaagagaaagtgaagatttttaagagttagaatacggagttggcgtttacggcgagtttgttgcgcgagtaggtggcgtagtttaagtagaaagtttttagttacgttaatagcggttgttagttgttgttttagtattaggtgttcgcgtattgagtttcgcgcgcggggcgtatgcgcggttattttttttaaggggcgggttcgcgggggggtgtcgtgggcgtttcggatttggagagggtgcggttttggggatttttttttttcgagtgtgtttaggaatttagagaggggcgcggttttcggggatttttttttttcgagggtgtttaggattcgataagttggattttttgttttcgggggggcgagcgtatgattttttcgttttcgcgttgtttttttttttcgcgcggtcgtttcgtgttgtataaattcgcgcgtttcggttgtttttttgtatatcgcgtcgcggaagggggtttcgagggggcgtagttttaaattttgttttttttttatttttattttttttttttttttttggaagagagaagaatagagtgttcgattttgttttatttatgtttttattcgggaataaacgttggttgtgtgtgtgtgtgtttttttgtgttggttttttaaagaaatgggaagaagaaaaaaaaatttttcgttttttttttcgatttcgttttttttttcggttttttcgatcggtttttttttttttttttgttttgttttgtt

SEQ ID NO: 88 - DNA, 5928 bp, Artificial Sequence
  chemically treated genomic DNA (Homo sapiens)
aataaaatagaataaaaaagggaggggggatcggtcgaaagaatcgaaggggggagcgagatcgaggaaaggggcggagaattttttttttttttttttatttttttaaaaaattaatataagaaaatatatatatatataattaacgtttgttttcgagtagaaatataaatagggtagaatcgaatattttgttttttttttttttaaagaaaaaaaaaaaaagtaaaagtaaaggaaaggtagggtttgaggttgcgttttttcggagttttttttcgcggcgcggtgtataaaggggtagtcgagacgcgcgggtttgtgtaatacggggcggtcgcgcgggggaaagaggtagcgcgagggcgggggggttatgcgttcgttttttcgggagtagggggtttagtttgtcgagttttgggtattttcggggggggggaattttcgggggtcgcgtttttttttgagtttttgggtatattcggggagggggggtttttagggtcgtattttttttaagttcggggcgtttacgatattttttcgcgagttcgttttttggggagggtggtcgcgtatgcgtttcgcgcgcgggatttagtacgcgggtatttggtgttggggtagtagttggtagtcgttgttgacgtggttgaggattttttgtttgagttgcgttatttgttcgcgtagtaggttcgtcgtggacgttagtttcgtgttttgatttttgagggtttttatttttttttttaggcgcgagatgcgttttagtttgcgtttgcggtatttgtgatgcgtgcgatgcggttgcgtagtcgtttgcgtttcgttttgatgcgtttttgcgttgtttatgtcgatgggcgataacggtggtgttttcgtcgaagttcgttatttgtgcgtttttttatagtttcggttcggcgcgatgagtttatcgtttcgttcgttattgggtgcgggtgacgtcgtttatttgtatggaggggcggggttaagtcgtcgacgttcgttcggtcgtcgttgtttcggcgacgcgcggtaaacgttataatagcgcgttgttttgtgggttgacgttatgggggcggtcgcgcgttcgggtcgggttatttcgtttcgggatcgttgtgtacgatcgattttttcggcgtcgttttcgttaaggtacgtttcgggtggcgtgatgggttcgggttattaggcgttcgttcgtttcgaggtttcgtttcgtgttcgcgcgtggggtttcgttcgggcgggggcgggggcgggggcggtgtcggttttcggggattggagggggatggggtttcgtatggttaaataattttttggcgttttttgttttgttgtgtcgttagggttttttttagcgcgttttttggagaggttttgtgcggatacggggttggaggtttggtggggttgtgttcgggggttcgtcgggggtgtggggaggtttgcgttttttattttttttttttttttttttttttttttttatttcgcgtgtgattgtttaggaagagacgggaggggagaggagggtcgttagaagttgttgaaagcgtttggattttgattatttttattgagtgcgttttagaattaggagttttattttttgtttttatagatgggaaattgggtttagagaggtggagtgattatttttcgagagttagttaggagttatagtagggttcgggttgtgattaggtttgagtttttgtttatttttagaattttagaatttgggagtttaggtttttgcgtagtttttttttttcgtcgtttacgttttaattttaggtttgttagggttgtgatgttttgggcgagggtgtttaattttaggggttgggttgatgaggtaggaatgtcgggtataattattatatgtttgttattattattatggttgttagggtttaatgagttattattaagattggttgggaagggggtgtgagggaggagagatggatttattttattaatatttataagggatttttaggatatttggatttgatttatagtttttgtatgtatttttttagttttttatttttgtttgaatggagtttatatttttttttttttgatttttttttttttattttttttgatttttggttttttagttgtaggattaatcgtatttttgggtttttgtacgtgttatgttttttgtttggtattttttttttttagtgtaaagatgtgtttttaggaagtgttttatttttagattttatttttttattgtagtttttgaatttgttagaatgatggagtggattatagtttttgaaggttagggatattgtttatgttgagtttgttgatagggtttcgtatagaatggatgtttagtattaaaggtgaatgcggggttgggtgtggtggtttatgtttgtaattttagtattttgggaggtcgaggtaggtagattatttgaggttagtagtttaagattagattggtcgaaatataaaaatataaaaaaaaaaaaaaatacgaaaattaatcgggtgtggtggtgtgtatttgtaattttagttatttaggaggttgagatatgagaatcgtttgaattcgggaggtagaggttgtagtgagttgagattgtgttattgtattttagtttgggagatagagtgagattttagttttaaaaaaaaataaaaaataaaggtgaatgtaataaaaggttgtttgtgtgggtggtttttagttttagtttgtttgtttggttagtgggtatgcgttattttttttttattttttttatttatttggttttgtttttaattggggtatgaaggttataagggaggttgtttttattattaagagaggtggtttgtcggttatacgcggtgatttttgtttgtaattttagtattttggaagtttgaggtaggtatttgaggttaggagtttgagattagtttgattattatggtgaaattttatttttattgaaaataaaaattaggttgggcgtagaggtttacgtttgttattttagtattttaggaggttaaggtaggttgattacgaggttaggagattaagattattttggttaatacggtgaaattttgtttttattgaaaaataaaaaaaaaaattagtcgggtatggtggcgggcgtttgtagtttttagttattcgggaggttgaggtaggagaatggtatgaattcgggaggtagagtttgtagtgagtcgagattatattattatattttagtttgggtaatagagcgagatttcgttttaaaaaaaaaaaagaaaaaagaaaagaaaaaaaaattagttaggtgtggtggtaggtgtttgtaattttagttagtcgggaggttgaggtaggagaatcgtttgaattcgggaggtggaggttgtagtgagtcgagattgcgttattgtattttagtttgggttatagagtgagatattgttttaaaaaaaaaaaagaagaaaaaaaaaataggttgggcgaggtggtttatatttgtaataagtattttgggaggttgaggcgggtaagttatttgaggttaggagttcgagattagtttggttaatatggtaaaattttgtttttattaaaaatataaaaattagttaggtatggggagcgtatcggtaattttagttgttttggagaaaggagaattatttgaatttaggagatggaggttgtagtgagttgaaattatgttattatattttagtttgggtaatagggtaagattttattttaaaaataataataataataataataataataataataataataataaagatttggtttggtaggtttgggatttaaattgttagggtagggaattggaggtgtgggtttgttttgtttttagattggttaggaaggtgtttgtttgtttattggagtgtgtgtttgtgtgtgtatttgtgtttgtttgtattcgtgttgtatagatagacgtaggtatatatagatatatatttagatttatgggtttttgtgttttttagtttaggttttattttggataaagagatttttagtgggataagatttagttcgtagatttgtagttagttttgttttgggaatttttttttgggtttcgtgtagtggggttagagtggaggagacggggttatgtttttttttgaggtaggaggtgagtgggcggtttatagaggttttgttttgaatttgggttttagttttggtagttggggagatggtttggtgaatggtaggttgagatagtttgagttgagtggagtatttttttgtaggtaggtaggtgagatatagaggtttgttaatttttttgagttttagttttttttttatgaaaattgagtaaataaatttatttattttgtggagtatcgcgatttttttttttgaaatgaaaggttttatatatttattattgaatttagttaatttatacgtttataatagatttagagaggaaaatacgtcgaattttttagatagtggtgatatttttagtttgatatgttaacgtgatcgtgatttttagatagtataaatatgtgtgttattttatgtgtaattttttatagatttagtttggtttttttttagtgtttttttggagttgtatttgattttatttttagtttttatttaaatttattggggaatgggacgattttgtttttgttttttgtttaggaatcgtttaattttgaaagttttgtaggaagatatggcgagaagtggagttaagaatatattacgatggtgtagaaaggaaaagtattgcgatttttattggatttgaagaaatagtaaggggttaggttgggtgtggtggcgtacgtttgtaattttagtattttgggaggttgaggtaggtggattacgaggttaggcgttcgagattagtttggttaatatagtgaaattttgtttttattaaaaatataaaaattttttcggtgtggtggcgtacgtttttagttttagttatttgggaggttgaggtaggagaattatttgaatttaggaggaggaggttgtagtgagtcgagatcgcgttattgtattttagtttgggtaatagagtgagattttaatttaaaaaaaaaaaaaaaagaaagaaaaaataaatagtaaggggttaataaatgttttttatgattgtattatttgtttaaatgtaattgtagttttttggttttgagtttttttagtttggaatatttttatatttttggcgaatttttatttattttttaaaatttattattttttttaagaaattttttttgattatgttttttaggatcgtcgttaattttttttatttggttaagatttgtttgttttttatttgtgttttgttttgttttttttatagaaggggaggggaggtttttaggattggatggggaaggttttttttggtttttaagtgtgggaagttgtttttgttatttttaagggtttttttttttttttttttgagatggagtttcgttttgtcgtttaggttggagtgtagtggtttgattttggtttattgtaattttttttttttgggtttaagcgatttttttgttttagtttttttaaatagttgggattataggtatgtgttaatacgttcggttaattttttgtatttttagtagagacggggttttacgatgttggttaggttggttttgagtttgattttatgatttgttcgttttagttttttaaagtgttgggattataggtttgagttattgcgtttggttttttttttttttttttttcgtattttttgttgttttattttaatgtttttttttatttttttttttttttttttagttagagagttttttgggatattttatttttgtttttttatttattttagt

SEQ ID NO: 89 - DNA, 5689 bp, Artificial Sequence
  chemically treated genomic DNA (Homo sapiens)
  unsure (3724, 3742..3743, 3755..3756, 3759..3760, 3872)
taatgttattatgtagatttgatttagtaggtttgggtggggattgaggttttgtattttttattagtttttttgtgatgtgtttgtagtgtagtttcgataagtttatttggggttttattaaagatatttaagtgtggatgaaaatgaatttttgcggttttagatgtattttagagaaatattgaaaaggaatattaaggaaattttttatttgtttcgtttttttttgtgtgtatgtgttttatttatgaaaatttttatatttgggttatttgaaagtttgttttttttttttttgagattgagttttattttattgtttaggtttattgtaatttttattttttaggtttaagtgatttttttgttttagtttttcgagtagttgggattaaaggcgtgtgttattatatttggttaatttttgtatttttggtagagaagggatttttttatgttggttaggttggtttcgaatttttgattttaaaatgattttttcgttttggttttttaaagtgttaggattataggagtgagttattgtgttcggtttaaaagttttttaaattttaaatgtatgagatttttttagttaattttttgttatttttttattttaattgtattaggtttaagaatatattaatattatagttttttaaaatttgttgagatttggttgggtagggtggtttatatttgtaattttagtattttgggaggtcgagataggtagattatttgaggttaggagttcgagattagtttgattaatatggagatattttatttttatagtaaatataacgttagtcgggcgtggtggtttatgtttgtaattttagttattcgggaggttgaggtaggagaattgtttgaattcgggagacggaggttgtagtgaatcgagattacgttattgtattttagtttgagtaataagagcgaaattttattttaaaaaaataaaataaaataaaaaaaattatttgttgagatttgttttatagttaagtatatggttaatttttgtaaatgttttatgagtgtttgaagataatatattttataattgttgggtgtagtgttatgtttattaggttaaattttttaattaggttgataggtttttatattttattgatttttaaaaggagatgtgttaaaatttttagtttttttattaggaaagttttttttttttattttagtttacgttatttacgataagtaaaatgttacgtggtttttgtagatttagtttttattttaatgtaattgataattttagaagatttttttggttattaatatttttttaattttattttatatttggtatttttttttttttttttgagtttttatagtatttattgtttatataaataatttgatatttatataatttgtttttattataattatttgagttgataatttatttttgttaggttttaaattttatatgggtaaagattattttattttttttttataatagttttattggaatatagttattgatatattataaaatttattttttagaagtatatagtttaatgggaaattattttatttattttggtatcgtttatagttgtggtttttagttttgggtgtatattggaattattggaagagttttaaaaaattttttagtttggaaaaaaaaaattttttagtttggattttttttttagaggttttggtttaattggtttggggtgtggtttggggatgggaatttttttaagtttttaggatgattttaatttgtagtcggggttgttttagagtgttttgtttatagtaggtatttaagaattgtttgttgtaattattaattagttttaatttttagtatttagttaattaatttatttaaaagtggtcgtttgtttttttaatagtttattagtttttattatataatggtttgtttatatttgtttttttaatttagtaggaaaggaatattatgagataaaagtatgtagaaaaggtaagtttatttgtaaagatgtgtagatttagtaggattggattattgaataagaaatataatagatattagatcgcgagcggtggtttacgttataggcgtgagtacgtgagtattttgggaggtcgaggcgggtgtattacgaggttaggagtttcgagattagtttggttaagttggtgaaattttgtttttattaaaaatataaagattagttgggcgcggtggcgggcgtttgttttagttattcgggaggttgaggtaggagaatcgtttgaattcgggagagggaggttgtagtgagttaagattgcgttattgtattttagtttgggcgataaagtaagatttcgttttaaaaaaaaaaaaaaaaaaaaagagagagagaaagaaatataatagatattaaaggaaaaaatgtaaaggaaaaagtattatatttatatttgtttttttagtatagatgatatgtttacgttgaggaatgtgtgttataagaattgtgtgtgatatatttttaaatttttatatttaaaagttagggataatatggtatttattcgggaattagtaatttatgggaaaagtttaagatgttatttattttggagattagatgtaaaggagtagtatgggtattttgttttagggtggaaagtgtttgttatggttttttttttttttatgggatttgttgtatatttttataatggcggtaggatcggtacgtttgtttgtatagttgtgagttgtatgaaggtagggatggttttggttttattcgttatggtatttttttgtggtaagttaggtgtttaataaatatcggtggaatgtatgtgattatattttatgttatagtatataaatatgattttaattggatagggaattgtaaaagttttttatattgattttttttgtaattttaattatggtattttgagttgggatattgtttaaattgtttgggttataataaattttgaaggggtttttatttttacgtttatagtggttgagggttcgcgttgtgtgaacgttggagttttacgtgagtagttgagtagcgaggatggttatttttagataaacgaatataggattttcgcggttgggagcggtcgttcggcgaggtcggttattttgtttgttcggtagtattacgaaatatttgttattgatatttttttattagttttcgagggttcgcgtaggtatttcgagtcgcgttttttggttcgtcgtagttagattttttttcgggcgggttacgtttttaggcgtaaaacggaattatttcgtatgaagaagataaagtataattagttatattaaagagaggtagtattatttagatagtcggttatttttttagagattttatttagttttttgggttcggcgtttagcgcgtagacggtgttcggttttaggagttttagttttttttacgtgttttgtttttttagtagttttttttgtcgtttcgggaggaaaattttttgataattcgcggtttgcggattacgatttttaggaggcgtcgcgtcgcgtttacgtagggagtcgtagttcgtagatcgcgagtagttaggagattttttttcgaggagaagagaagatgtggaagaaagatagtagagagagagggtgagtttatttttatatgtttttttttttttattatttaaaaataattaaaaaaanataggagagtttaataannttaaaaaaaaanntannataagaaaagataataatgatataaaaaatttattaatgaaaaagtgtaaatgaaaaggaataaatattaattaagtgatttattttatatatattagagtaaagtgattantggaggttataaaataaaaatgagtaagagaatgatataaaaaatatatagagtagaaaatagtatgtaggataaagtggtgaaaaaaaagtgaaaatgttaaaaaatagaaaaaagcgaaaagtaatgataaataaagatacgtagtatattagtttaattaatgaagtaagataaataagaaatatataatttattaagaataaataaaatgttaattaaagtagttggtaatattaatagaggggtaggaggaatgtttggtagcgttgaaaatgtaaatatatagttgataaaagatatttacgatgtataagtcgtatataatttattttacgagtaatatagtaaaaaagataatgtttatagtagaataataattaaataaaaatttgtttttaatatataatatattataaaatgcgaaaattaattatatagaggagataattatatttgagtaaatatgaataattatattattatattaatgtttaatatataatttaatatatgattaaaaaataaaaaataatatgtatttatttatataatttatatttggatattaaaaatgtaatgttttataattaaaataaattaattttttattaaaaattaatatatataaatttataaattatcgttttttttttttttttcgggtcgcgtaggcgttttgggtttcgttattaagtcgggttggcgtcgtttggatgcggtttttttcgggatttgtagtttttttggagttattcgggtcgtttgttagagggataagatttataagtttcggttgttttagcgttgcgagtttggttacgtggcgggggtcgaacgggcgtgcgtgtcgtcgttgattcggtgttgtagtgaggaggtggtttttgttcgtgttgtgtgtgtgtgtgagtgagagagcgagtgagtgagtgagtgagtgtgtgtgtgggggggattcggtttgttgttgtcggtgattttttttttttttttattttttttttttttcgtcgtcgttgtagtggtcgttttttgggtcgtaggaaatgagcgataacgatgatatcgaggtggagagcgacgtgagttttggggttttttttttttcgtgcgggttgttaggcggggatagcggtcggggtttttagcggggcgacggcgggagggggtcgggttgtcgtcgttttttttttttttttttcggggttaggagtgttttcgtcgcgttttcggttcgttttttttcggtttttggtcggagcggttttttgggattggaggttgggggaagatacgcggtttttgggatttttatttttttttttgcgggagggtgttgcggtttttcgtttttatttttttcggtttaggattcgggggataaggatggggggcgttcgggattttattgttcggatttaggggaaggggacggcgtttaggatttgttttttcggattgcgatttttttttttcgtgattcgcggattttgggggtcggggaagggcggagaggggttgggggtgtttagatgttcgagttgggtttgtagggaggagatagttttcgggatttttttggtttaggtcggatttcggaaggaggggcggcgttcgggatttttttattttgttatcggatttcgtcgagggtggaagggtgggggtaaggggtggggagggaggaaggggtgtcgggttgattttttatttttcgttttttttgtcgtcggtatttttttttttattattgaatgttaagtgtaaaaataatttttatattttttattttttttttttttttttattttagg

SEQ ID NO: 90 - DNA, 5689 bp, Artificial Sequence
  chemically treated genomic DNA (Homo sapiens)
  unsure (1818, 1930..1931, 1934..1935, 1947..1948, 1966)
tttggaataagagagaaaaaaaaaaatagaaaatatagaagttatttttatatttaatatttaataataagaaagaaaatgtcggcggtagaggaagcggagggtggggagttagttcgatatttttttttttttttttattttttgtttttatttttttattttcggcgggattcggtagtagggtagaggggtttcgagcgtcgttttttttttcgggattcgatttgggttagaggggtttcgagaattgttttttttttgtagatttagttcgggtatttaggtatttttaattttttttcgttttttttcggtttttaggattcgcgggttacgggaggagaggatcgtagttcgaaggggtaggttttgaacgtcgttttttttttttggattcggataatgggatttcgggcgttttttatttttgtttttcggattttgagtcggggaaggtgggagcgggaggtcgtagtattttttcgtaagggaggaggtgggggttttagaagtcgcgtgtttttttttaatttttagttttaggaggtcgtttcggttaggagtcggaggggagcgaatcgggaacgcgacggaggtatttttggtttcgaggggaaggggaaggaggcggcggtagttcggttttttttcgtcgtcgtttcgttaagagtttcggtcgttgttttcgtttgataattcgtacgggaaggaagaagttttaggatttacgtcgttttttatttcgatgttatcgttatcgtttattttttacggtttagggagcggttattgtagcggcggcggggaggggaaggggtgaaggggagggggaagttatcgataataataagtcgagttttttttatatatatatttatttatttatttattcgtttttttatttatatatatatataatacgggtaagaattatttttttattgtagtatcggattaacggcggtacgtacgttcgttcggttttcgttacgtgattaggttcgtagcgttggggtagtcgagatttgtagattttgtttttttaatagacggttcgggtagttttagaaaaattataaatttcggaagaaatcgtatttaggcgacgttagttcggtttgatgacggagtttaaggcgtttgcgcgattcggggaggggggggggggcggtggtttataaatttatatatattagtttttaataaaaagttaatttattttaattataaagtattatatttttaatatttaaatatgaattgtatagatgaatatatgttattttttattttttaattatatattaaattatatattgaatattaatgtagtaatataattgtttatatttatttaaatataattattttttttatgtaattaattttcgtattttataatatattatatattaaaaataaatttttatttgattattattttattgtgaatattattttttttattatattattcgtgagataaattgtatacgatttgtgtatcgtaggtgttttttattagttatatatttatatttttaacgttattaaatattttttttatttttttattaatattgttaattattttaattaatattttatttatttttgatagattatatgttttttgtttgttttgttttattaattgaattaatatattgcgtatttttatttgttattatttttcgtttttttttattttttaatatttttattttttttttattattttattttatatattattttttattttatatattttttatattatttttttatttatttttattttataatttttantaattattttattttaatatatataaaataaattatttaattaatatttatttttttttatttatatttttttattaataaattttttatattattattatttttttttatnntanntttttttttaannttattaaatttttttatntttttttaattatttttaaataataaaaaaaaaaaaatatataaaaataaatttattttttttttttattgttttttttttatattttttttttttttcggaggaaaattttttgattattcgcggtttgcggattgcgattttttgcgtgagcgcggcgcggcgttttttgggagtcgtagttcgtagatcgcgagttgttaggagatttttttttcgaggcggtagaggaggttgttgggaagataggatacgtggagggagttggagtttttggagtcgggtatcgtttgcgcgttggacgtcgggtttaggggattgggtggagtttttgggggagtagtcggttgtttaaataatgttgtttttttttggtgtgattggttatattttgttttttttatacggagtggtttcgttttgcgtttaggggcgtaattcgttcgggagggaatttggttgcggcggattagggggcgcggttcgggatgtttgcgcgaattttcgggggttggtggggaggtgttagtggtaggtgtttcgtggtgttatcggataggtagaatgatcgatttcgtcgggcgatcgtttttagtcgcgagaattttgtattcgtttatttgggagtgattattttcgttatttagttatttacgtgaggttttagcgtttatataacgcgaatttttaattattatggacgtggaagtaaaagtttttttagagtttgttgtagtttagatagtttaggtaatattttagtttagagtattataattaagattgtaaaaaggattaatatgggaaatttttgtagttttttgtttagttaaaattatatttatatattgtggtatgaagtgtaattatatgtattttatcgatatttattgaatatttaatttgttataaggggatgttataacggataagattaaaattatttttgtttttatgtagtttatagttgtgtaagtaagcgtgtcggttttgtcgttattgtaagagtgtgtaataagttttatgggaaggaagaaaattataatagatattttttattttgagataaagtatttatattatttttttatatttggtttttaaagtgaatgatattttgagttttttttatgagttattgattttcggatgaatattatattatttttgatttttgaatgtggaaatttggggatatgttatatataatttttgtgatatatattttttaacgtgagtatgttatttatgttgaaaagataaatgtaaatgtggtatttttttttttatatttttttttttaatatttattgtatttttttttttttttttttttttttttttttttttttgagacggagttttattttgtcgtttaggttagagtgtagtggcgtaattttggtttattgtaatttttttttttcggatttaagcgatttttttgttttagtttttcgagtagttggggtaggcgttcgttatcgcgtttagttaatttttgtatttttagtagagatagggttttattaatttggttaggttggtttcgaaatttttgatttcgtgatatattcgtttcggttttttaaagtgtttacgtgtttacgtttatagcgtgagttatcgttcgcggtttaatatttgttgtattttttatttagtgatttagttttattaagtttgtatatttttgtaagtgaatttattttttttatatgtttttgttttatagtgttttttttttgttgagttggggagatagatataagtagattattatgtgataagagttgatgggttattggggagatagacggttatttttgagtgagttaattaattggatattagaagttaaagttaattgatgattataatagatagtttttgggtgtttgttatgaatagagtattttagggtaatttcggttataagttaaaattattttaggagtttaaaaaagtttttatttttaggttatattttaaattaattaagttagaatttttgaaggggagatttagattgaaggattttttttttttagattgaaggattttttaaagtttttttagtaattttagtgtgtatttaagattgagaattatagttatagacgatgttagaataaataagatagttttttattgaattgtatgtttttaaagagtgaattttatggtatgttaataattatattttaataaaattgttataaaagaaaaataagataatttttatttatgtggaatttaaaatttgataggagtaaattattaatttaaataattgtgatgaagataaattatgtaagtgttaaattgtttgtatagatagtgaatgttgtaagagtttagaggaggaagaaggagtgttaggtatgaggtggggttggggaggtgttggtgattagggaagttttttgaggttgttagttgtattagggtaagggttgggtttgtaaaggttacgtaatattttgtttatcgtgaataacgtggattgaggtgaggaggaaaggtttttttggtagggagattggagattttaatatatttttttttaggaattaatagaatatgaagatttgttaatttgattaagaaatttgatttaatagatataatattgtatttaatagttgtagaatatgttgtttttaagtatttatggaatatttataaaaattgattatgtatttagttataaggtaaattttaataagtggttttttttgttttgttttgtttttttgagatggagtttcgtttttgttgtttaggttggagtgtaatggcgtgatttcggtttattataattttcgtttttcgggtttaagtaatttttttgttttagtttttcgagtagttgggattataggtatgagttattacgttcggttaacgttgtatttattgtagagatggagtgtttttatgttggttaggttggtttcgaatttttgattttaggtgatttgtttgtttcggttttttaaagtgttggaattataggtgtgagttattttgtttagttaaattttaataagttttaaaggattataatattagtgtatttttggatttagtgtaattaaagtagaaaaataataaaaagttaattagaaaagttttatatatttgggatttaagaaatttttaggtcgggtatagtggtttatttttataattttagtattttgggaggttaaggcgggaggattattttgagattaggaattcgagattagtttgattaatatggggaaattttttttttattaaaaatataaaaattagttaggtgtggtggtatacgtttttaattttagttattcgggaggttgaggtaggagaattatttgaatttgggaggtggaggttgtagtgagtttgggtaatagagtgagatttagttttaaaaaaaaaaaaagtaaatttttaaatgatttaaatgtagggatttttatgagtgaggtatatatatataggaaagaacgaggtagatgagaagtttttttagtgtttttttttagtgtttttttgaggtgtatttaggatcgtaagaatttatttttatttatatttgagtgtttttggtaaaattttaggtgagtttatcggggttgtattgtaaatatattataaggaagttggtaagaaatatagaattttagtttttatttagatttattaaattagatttatatgataatatta

SEQ ID NO: 91 - DNA, 6018 bp, Artificial Sequence
  chemically treated genomic DNA (Homo sapiens)
tttatttttttattttttaggatagagttttgttttgtcgtttaggttcgagtgtagtggcgcgatttcggtttattgtaatatttgttttttaggtttaagagattttgttgttttagtttttcgagtagttgagattataggtttgtattattatgttcgtttaatttttgtatttttagtagggacggggttttatatgttggttttaaatttttgatttttagtgatttgtttgttttggttttttaaagtattgggattataggcgtgagttattgcgttcggttcggattttgttttttaaataatattatttagttttagatgtttggaaagatataaggaatttgaattatttttgtaattttagatggttttataaatattgtgaaatttagtattttaaatacggtttttgagttaaattttgtttagtttttattatgttttaaagattagttgtggttaggtatagtggtttacgtttgtaattttagtattttgggagggtgagacgggtggattatttgaggttaggagttcgagattagtttggttaatatagtgaaatttcgtttttattaaaaatataaaaattagtcgggtatggtggtataagtttgtaattttagttattcgggaggttgaggtaggagaattatttgaatttaggaggtggaggttgtaatgagttgagatcgtgttattgtattttaatttgggtgatagagtgagatttcgttttaaaaaaaaaaaaaaaagaaagataaaagattagttatgattaataaatataagtacgaagtggtttttgggttaagataagtttgttgtagatttttttttttttttttgagatatggttttattttgttatataggttggagtgtagtggtaggattatattataatttattcgggtttaagttatttttttagttttggtttttaagtagttaggattataggtgagtgttattacgtttggttaatttttttttgtaatttatagagatagggtttcgttatgttgtttaggttggttttaaatttttggttttaatagattttttagttttggttttttatagtgttgggattataggtgtgagttttgtttgtagagtttaggttttagagaatataaagatatttaaagtattttaattttttggaatattttttgggtattaagaataacgttattagaaataagtagtttgtttttagagaaattttaagtaagtataataaagggtaaagtgatataagataattgtggaatgtaagtaaatagtagtagttggtttgtatttttttaaatggtaaagttataaataatagtaattgtttttagagtgagtaggtagtttgttttttttttttttaaatggaatttattttttaagtgatgatatgtatttgggggtgggtaggtgtgagtttatttgtgttttgaaattttaaattaatgagtatgataaatcgttattgttggttttgtttgattttttattttgagtaattggtgggttttttttaatttttttttaatttttattttttttttttttttattgatttgggatagtttttgttaaagtgttaattatagtgggaaggaggagaaggggggaggttatagtgtatgggatttaaggttatagtgggcggagtaacggggattattaggtaagtaagttaagttttcgttgtttaagtttagttgtttgttacggtagtgtaatttttggcggacgatttaggacgcgttgacgcggtagtcgcgttatttttttttgtttgtatttatttgcgttgtttgaagtcgtgtgatttattaggatttagaggttgtttgattatattattgggttgtttgttgttttcgggttaggagattttggttggtttgaagggaagaagattagaggaagatttatcgaggatgggttttttttgttttttttcgggttggcgttgtttaggattcgttttttggtttcggtgtattcggttttttattgtgttagggatttgattggaagggcgggtttgttagcggatttggggttgttgattatatcgttgttggtgggttttttgaggatgcggatttgtggagggggtttcgggggaaaattattattttgaattataatgggtattttgggagatttgaattttttgttttttgtgtgatttttagttttttttttagacgtttattttttcgttgtttgtcgtttttttttagtttttagtaatttttttatattttattttattcgttattttttagatcgtttgtttttttatttttatattttttttgatttttgtagtatttaatattattatttgattttgattttttagatattattatatggtttttggttttttggtcgttttttttatttttttgttgttttaagttttgtttttagtttaagttttttattatcgaattttgttttgtgatttataatttaaaattaatttaattttttattttttttagattttttttggtaagtagtattattatgttttaggtggatattgagttatattgttgtggtagtgttggtatacgtagttttgaatattaggtttttgagtgaattttttttattttttttttttttttttattttcgttttttttttttgtttttatttttgattttttttttttggttttattagaaaaggattaattttattagttttgtttttttttttttgttttaataattttgttaagataatttttttaaagtataaggttaatgagaagggggaaagtcggtttagaaggtagtcggttcgattattttgagtttgaatttatttttggtggttttgttaaaatatagtttgaagtaaattatttgtttttatgtttttaatgtttattttgtcgaaagtttaaatttttttgtttggtatttaaggagattttaagtttttaaaatttttttttgatttttatgtaagttaaacggatttatttattgtattttaaatagtttttttatatttttttttttgtattttttgataatttttttgtgtttggaatattttttgtttttatttaagttttattattttttaagatataaaatatgtgtgatttttgaggtttttgtgaattgtttttagtatttattaagtaattaattttgtttttgaatttttatagtataaatttattcgtttatttgatatttaataaatattaatttttattatttattttttttttttttttttttttttgagatggagttttgttttgttatttaggttggattgtagtggcgcgattttcgtttattgtaatttttgtttttcgagattaagcgatttttttgttttagttttttaagtggttaggattataggcgttcgttacggggttcggttaatttttgtatttttagtagagataaggttttattattttggttaggttggtttcgaatttttaatttcgtgatttatttattttagttttttaaagtgttgggattataagcgtgagttatcgtgcgtagtttattatttatttttttatgtttatatttttttattgtttgagatttttttttatttagggttaagtattgagtttattagaaattttattgtatatgatttgatgaagatgagattatttttttaaaagttatatattaaattttttaagttaataatattggtaattaatttaaattaattgagtgattattatgtttaaggaagttttttttttggtaggttgggaagcgggagaagggaaggatataattttataaaaaaaaaaaagttgtagaagggaaggatataattttataaaaaaaggtttttgtttataaggagttaattatttattggttagagaagaaacgtgttttttttttgtaatggttgtgtttttgggtttagttaatttaattttttatgtttttaatttatgagatcgtattaaaaacgtttttgttatatttttgtgggaaagtaggtgagttagaatgagtgtataatatataagtatatattttaatgataatgaatgtgtagattaataaatttaaattttgtttttgtttttttgagagttttgttttgtcgtttaggttggagtgtaatggtatgattttggtttattgtagtttttgtttttcgggtttataggattgttttgttttagttttcggagtagagtagttgggattataggtgatcgttattacgttcgattaatttttgtagtttttagtagagacggcgttttttatgttggttaggttggttttgaatttttgattttaagtgatttattcgtttcggtttatttaaagtgatgggattataagcgtgagttatcgcgtttagttaaatttaaatattttaaaagcgtagagtaatcgttttttttttcgttaacggtaattagtattttcgttttttaattagaatagttgtatgtatcggtgtataagtttgttttaagtgttatttttaattttttttaaaaataggttttaaaataatttatttgggtataattttagcggttggtggagtgggtttaatatattaaatagttgttaattttggtttttttttggtaatagcgatacggagattcgtatttgtcgtagtttttatcgcgggcgggaagtgtaaatataagaaatataaatatagcgtaacggttaaaggagtgttatagcgttaaattttgttggtttcgcgttaggtcgagttttatttttttagttcgcggttaatatttttatttcgttttatagttcgtcgcgttcgcggggcgatattttttattttattatttcggaggtggtgcggtcgagtttcggatttaattggcggaagcggggtcggttgtgtgcgcgcgtataaatgttcggatgcgtcgcgacgattcgcgcgtttttttcgggcggtagggggcgcgtatcgaggtatcgcggcgagtttggttgtttttggggtttgtgtggttttgtgtgtcggaaagatggagtaagaagtcgagttcgaggggcggtcgcgatttttttgatcgagattttgttgttttcgtagttaggagtatcgttttttttcggattagtgcgtacgagcgtttagtgttttggttcggagagtggaatgattttcgaggtttagggcgtcgtgttttcgcgcgtttcgtgaaggaaattggggagttttgagggattttcgattttaagcgcgaaaatttcggatggtgaggagtaggtattggttcggtagcgagcggttatttttgggtttgggttttgacggtgttttttttatcgttggtttttagtttttgttcgttcgtagtttttgtgcggttcgtggttgggggttcggggcgcggggcgcggggtatggggtacgtggttttgcggaggttttgttggattggggttaggtagtcgtcgttagggaggagggcgggatttcggacggttttcgcggcggtgggggtgggggtggttcggaggttttcgcgggagtttagggtaaaggttacgggggtcgggggttgcggggtcgtttcggcgcgggaggttcggatgatcgtaggtgtttgtcgggttattagtgtgaacgttgcgcgtagtttgggcgggattgggtcggtttagtgggtaggttgatttagtttttttttttgagttggttaagtttagatacgtttcgaaattgtagtaaaaggagttaagttttgatttgtttttagttggggttatttaaattatgtatttttttagttgtgtttagtggcgattggagggtagatttgtgggtacggacgtacgttattttttttttgttgatttaggtaagtatcgatttgtttgtagttttagttttaattgttgtttatgttttttatatatgatgtattttttatagatgttttatgatttttagtttttatcgtgttttttttttttttgtagg

SEQ ID NO: 92 - DNA, 6018 bp, Artificial Sequence
  chemically treated genomic DNA (Homo sapiens)
tttataaggaaaaaaaagatacgatgaaaattggaaattatgaaatatttgtggaaaatatattatatataaagaatataaataatagttaaaattaaagttataagtaagtcggtgtttatttggattagtagagaaaaagtggcgtgcgttcgtgtttataggtttattttttaatcgttattgaatatagttgggaaaatgtatggtttaaatagttttagttggagataagttaggatttaattttttttattgtagtttcggaacgtgtttgaatttgattagtttaagaggaaaagttgagttaatttgtttattgaatcggtttaatttcgtttagattacgcgtagcgtttatattagtgattcgataggtatttgcgattattcggatttttcgcgtcgaagcggtttcgtagttttcggttttcgtgatttttattttgaattttcgcggagattttcgaattatttttatttttatcgtcgcgagagtcgttcgaaatttcgtttttttttttggcggcgattgtttagttttagtttaataaaattttcgtaaagttacgtgttttatgtttcgcgtttcgcgtttcgagtttttagttacgaatcgtataaaggttgcgaacgggtagaggttgggaattagcgatagaggggatatcgttagagtttagatttaaaagtgatcgttcgttgtcgggttagtatttgttttttattattcggggttttcgcgtttggagtcgggggttttttaagattttttagttttttttacggggcgcgcggaagtacgacgttttgggtttcggggattattttatttttcgggttagggtattgggcgttcgtacgtattaattcggggagggacggtgtttttggttgcgaaagtagtaggatttcggttagaggggtcgcggtcgtttttcgggttcggttttttgttttattttttcgatatatagggttatataggttttagaagtagttaagttcgtcgcggtgtttcggtgcgcgttttttatcgttcgaggggagcgcgcgggtcgtcgcggcgtattcgggtatttgtgcgcgcgtatataatcggtttcgttttcgttaattgggttcggggttcggtcgtattattttcgggatgatggagtggggggtgtcgtttcgcgggcgcggcgggttgtgaggcggggtgggggtgttggtcgcgagttgagagggtggggttcggtttggcgcggagttagtaaggtttggcgttgtgatatttttttagtcgttgcgttatgtttgtattttttgtgtttatatttttcgttcgcggtggaaattgcgataaatgcggattttcgtgtcgttgttattaaaaagaaattaaaattaatagttgtttaatatattaagtttattttattagtcgttggagttgtatttaaatgagttattttaaggtttgtttttaaaaaagattaaaaatagtatttaaggtaggtttatatatcggtgtatatagttgttttggttggagaacgaagatgttggttatcgttggcggggaggggagcggttattttgcgtttttagaatgtttgggtttggttgggcgcggtggtttacgtttgtaattttattattttgggtaggtcgaggcgggtggattatttgaggttaggagtttaagattaatttggttaatatgggaaacgtcgtttttattaaaaattataaaaattagtcgggcgtggtggcggttatttgtaattttagttattttatttcggaggttgaggtaggataattttgtgaattcgggaggtagaggttgtagtgagttaagattatgttattgtattttagtttgggcgatagggtaagatttttaaaaaaataaaaataaagtttgggtttgttaatttatatatttattattattaaaatatatatttatatattatgtatttattttgatttatttatttttttatagagatgtggtaaaaacgtttttgatgcggttttataaattgaggatataaagaattgagttagttaaatttaaaaatatagttattgtaaagaaggaatacgttttttttttggttagtaagtgattagttttttgtgaataaggatttttttttataaagttatattttttttttttgtagtttttttttttttataaagttatattttttttttttttcgttttttagtttattagaaaggaaatttttttaaatatagtggttatttagttgatttaagttgattgttaatattattaatttaagagatttaatatgtggtttttaaaaagataattttatttttattagattatatatagtggggtttttaatagatttagtgtttgattttggatgaaagaaaattttaagtagtgagaaaatgtaagtatgaaaagataagtgataggttgcgtacggtggtttacgtttgtaattttagtattttgggaggttgaggtgggtggattacgaggttaggagttcgagattagtttggttaagatggtgaaattttgtttttattaaaaatataaaaattagtcgggtttcgtggcgggcgtttgtaattttagttatttgggaggttgaggtagaagaatcgtttgatttcgggaggtagaggttgtagtgagcggagatcgcgttattgtagtttagtttgggtgatagagtaagattttattttagaagaaaaaaaaaaaaaaagagataagtgatagaggttgatatttgttaaatattaagtgaacgaatgggtttgtgttataaaagtttagagatagaattaattgtttagtaaatgttggaggtagtttataaaggttttagagattatatatattttgtgttttgaaagatggtgagatttaaataaaagtagagaatattttaggtataagaaaattattaaaaaatatagaaaggaaaatataagaggattgtttgagatataataaataaattcgtttgatttgtatgaaagttaagaagaagttttaagaatttggagtttttttaaatgttaagtaaggaaatttgggttttcgatagagtagatattagaagtataaaaataagtgatttgttttaaattgtattttaataggattattaagagtagatttaaatttagaatagtcgggtcggttgttttttggatcgattttttttttttttattggttttgtgttttgaaaaaattattttgataaaattattagagtagaaaaaaaaaggtagaattgataagattagtttttttttaatggaattagaaaagaagggttagaaatgaaggtagaagggagaagcgggggtgggggagagagagagaagtaaaaaggatttatttaagaatttggtatttaaaattacgtgtattagtattattatagtagtatgatttagtgtttatttaaagtatgatgatattgtttattaaaaaaagtttggagggaatgaaaagttgggttagttttaagttatgggttatagaatagaattcggtggtaaaaagtttaggttgggaatagagtttgaaatagtaaaggaatgagaggaacgattaaaaagttaaggattatatagtgatgtttgaaaaattagaattaggtaataatattgaatattgtaaaagttagagaaaatgtggaaataagaaagtaagcgatttggaaagtggcgagtaagatggaatatgaggaggttgttgagagttgggaggagacggtagatagcggggaaatagacgtttggaaaaaaaattgaagattatatagaaagtaggaaatttaaattttttaaagtgtttattgtgatttaggatgataattttttttcgggattttttttataggttcgtatttttaagaggtttattagtaacggtgtggttagtagttttaagttcgttagtaggttcgtttttttagttaagtttttggtatagtgggaagtcgagtatatcgaggttaggaagcggattttgggtagcgttaattcgaggagaagtaggagaaatttattttcgataggtttttttttgatttttttttttttaggttaattaggattttttaattcgaagatagtagatagtttaataatgtgattagatagtttttgggttttgatgggttatacggttttaaatagcgtagataaatgtaggtaagaagagatggcgcgattgtcgcgttaacgcgttttgggtcgttcgttaagggttgtattatcgtggtagatagttggatttgagtagcgggaatttgatttatttgtttggtgattttcgttgtttcgtttattgtgattttgaattttatgtattgtgatttttttttttttttttttttttattgtgattggtattttgataaggattgttttaagttaatggaaagggaaaaagggtgagggttaggagaaggttggggggaatttattaattatttagagtagagagttagatagggttagtaatagcggtttattatgtttattaatttgggattttaaaatataaatgaatttatatttatttatttttaagtgtatgttattatttaaaaagtgagttttatttgaaaaaaaagaaagtaaattatttgtttattttaaaagtagttgttgttgtttgtgattttgttatttaaaaaaatatagattagttgttgttgtttgtttgtattttatagttattttgtgttattttgttttttgttgtgtttatttgaagtttttttagaggtaaattgtttatttttagtagcgttgtttttgatgtttaagaggtgttttaagaggttgagatattttgagtgtttttatattttttgggatttaaattttgtaaataaggtttatatttgtaattttagtattgtgggaggttaaggttggaggatttattgaggttaagagtttgagattagtttgagtaatatggcgaaattttgtttttataaattgtaaaaaaaaattagttaggcgtggtggtatttatttatagttttagttatttgggagttagagttgggaggatggtttgagttcggataggttgtggtgtgattttgttattgtattttagtttatgtgatagagtgagattatgttttaaggggaaaaaaaaaagtttataatagatttattttgatttaagggttatttcgtatttgtatttattagttataattaattttttgttttttttttttttttttttttgagacggagttttattttgttatttaggttggagtgtagtggtacgattttagtttattgtagtttttattttttgggtttaagtgatttttttgttttagtttttcgagtagttgggattataagtttgtgttattatattcggttaatttttgtatttttagtagagacgggattttattatgttggttaggttggtttcgaatttttggttttaggtgatttattcgttttatttttttaaaatgttgggattataggcgtgagttattgtgtttggttataattaatttttaaagtatggtgaaaattaaataagatttagtttagaaatcgtgtttagaatgttgagttttataatatttatgagattatttaaaattatagaagtagtttaaattttttatgtttttttaaatatttggaattgaatagtgttatttaaaaggtaaaattcgggtcggacgtagtggtttacgtttgtaattttagtattttgggaggttaagataggtagattattgaaggttaggagtttgagattagtatgtaaaatttcgtttttgttaaaaatataaaaattaggcgggtatggtggtgtaagtttgtaattttagttgttcgggaggttgaggtagtagaattttttgaatttgggaggtagatgttgtagtgagtcgagatcgcgttattgtattcgagtttgggcggtagagtaagattttgttttggaaaataaaaaagtaaa

SEQ ID NO: 93 - DNA, 5908 bp, Artificial Sequence
  chemically treated genomic DNA (Homo sapiens)
gttaagtagaggagagtttttttagattggtttttgggttttttagatatgattatagtaggtttttatttttatgtttttagagtatttttgtttgttgatgtgataaaatgttttagggttattttgtaggttttttgtttcggatttggaatttattatttttataaggaaatttaattttttttaatggaaaatggtttttaaggttataatttaggatgtaaggatatttataattatggggtaaatttaaggtttttttagtggatatataaggaaatttgttttattttaaattttgaaagataatatattatgagtttattttgatatttttagtatagaatttattgaatgttataaggagttagattttatttttgatgtttgatgttcgattgttggtggttttaaagttttatttttttttttttttattttttaattttatatttgggtaaattaataagaaagttttagttttttttttaatttatagaggttttgttattagtttttaataggttttagttttaattataagttagatttttttttgtttttttaggttattttatatttttttgggaggtttatttgttgttttaaagagtttaattatgtgagtaataattttttttatattttttgggtggatgtgtggtattattagttttgatatttaaattaaattttgggtggggatttttttttgtttttgtatagtggttataaaatataattttttgattttatatttttttttttttaggttaaaaaaattttatttttagtgatgtttaaataatcgtttatttgttttattttattataatatataggtttagaaaaatattaatattattattaatataatttttggaaattgattaattttggtttttagtttattttatttttagagaatgtttgtttagagaagtatttttatattggtgtgtttaaaataattaaattatttttttttatggagttatattgttgtatgatatatagttgtattttaatttttatttttagggttttttttttttgtttttattgatttaattggttttatatttatgtaaatatttataaggtttaaaagttaagtttattaaagaagatagtttagagaaattgggtttttatttttatttttttttttttttatatttacgttgtatggtttatttttttgtagtttttttttaataaaagtagatgtgtatatatatttataagtttatattttttgatgttatgttttgttttattgtttttttttaaagttggagagttgagatttatgttttggtttttttttgtttaggtggttaatttgtgtgcgggtaggtgggttgatgtagaattttttgtggttggagtaggtttttatcggttaaggtatatttaggttgattttttttttggaggttttataatatttgttttaggagtggtttatttagttataaagtttatttttttttttttttttaggaagtcgatatagttggttaatatgttaaaatttgattttattaaaagtattatatatatatatatatatatagtaatatatatattaattatatatagtatatatattttatatataattgttatatatagtatatatattatatataattattatatatatagtatattatatatatatatatatattatatattatatatagagagaggatattatatatatatatatatatatatatatatatatatatatatagcgatagtatattatatatatatatatatatatatatatatatatatatatatatatatatatataatatatatatatatataaattgtgcgtggtggtttatatttgtagttttagttatttagggggtcgaggtaggagaattgtttgaatttaggagttagaggttgtagtgagttaagattgtgttattgtattttagtttgggtgatagagtgagatttagttttaaaaaaaaaaaagtgaaattttatttttattaaaaatataaaaaaaaaaaatagttgggtttagtagtagatatttgtaattttagttatttgggaggttgaggtaggagaatcgtttgaatttgggaggcggaggttgtagtaagtagagattgtattattgtattttagttcgggggatagagtgagattttattttaaaaaagaaaaataataatagtaataatagaaaagaagtaatttaaaatgttttaaagaagtaatttaaaatgttttttttttttttttttttttttttttttttttttttttttttttttttttttttttttttttttttttttttttttttttttttttttttttttttttttcgttttttttttttgttttttttttttttttattttttttttttgatggagtttcgttttgttgtttaggttgaagcgtagtggcgtgattttggtttattgtaattattgtttttcgggtttaagtgatttttttgttttagtttttcgagtagttgggattataggcgtgtgttattatattcgattaatttttgtatttttagtagagatggggttttattatattggttagtttggttttgaatttttgattttatgatttatttattttggttttttaaagtgttgggattataagtatgagtttttgcgtttggtttagtattttttagttttaattaggttgtatttatgagggtggaagaattgtttttggaaataagtagtaattaggatgagaaaagttgtgttttatggggttatgtagtggtgggttttgtttgatcgtttaatgggggaaaatatggaaatttatgttttttaaaacgtttatataatagtattttcgtattgaatttttttacgttagatttggtttatataatttagagttgttgttttgtgtttttatgttgtttttttagtttttttatttttattagtagttgatatttttgtagttgttttagagtagagggtttagtttttttaattttgtggtttttttatatttttaagaattattgagaattattaggaatttttgttaatgtggatgggttatatttagttatatttatatatttaaagttagggttaaggaatttaaaaatatttatttattgatttattttaagatagtgatgtatttattttatgttaatattaataatttatttttatggaaaaaaaataataaaatgaaaatagcgttttagtttatatttttgtaaatttttgtaatatttggttgaaacggagatagtgggagtttttttattgtttttgtatttgtagaattatattttatatttttgggagtatgagaatgagaagggtaagtaatatagagggttattagataaatggttttgattttatggattttttgaaaggaataggaagtttttaggggttttttgtatcgaggtttttttgattaagggagttaagttttaagggttgttggggagttggaggaggtgagatggggtagagaggtcgttgttattaaaagcgtgtttaggttttatttattttattttaggtggtttattgagtttatatggttattagcgtaattgaagtagatttcgatagaattttgtgtagaattattttaggatttatttattttggtatgtataagttattttaattgaagaatgttttttaataataaaatattgtaaatttaagtatgtggtaatagtaatgattaagtaaattatggtttttcgaagtttagtgttttgtagttattagagagtaaaagcgagaatgtgtttagtggagatagttttaggatatttaaaagtagagagtataaagtatagaatcgtgttgtgtatgttatgatttttttttttgtgtttttgaaaaagagaatatacgtatagtaggaaaagatatattaaattattttatataattggttgtttttgtgtttggtaagatgtatgtattgaagaggaaggtttcgattttttttttttttttttttttttttttgagatagggttttgttttgtcgtttaggttggagtgtagtggcgcgattttagtttattgtagtttcgatcgtttcggtttaagcgatttttttattttagttgttttagtagttagaattataggggcgttattacgtttggcgaattttttgtagagatgggttttttttaggtggtttaggttggttttgaattttcgggtttaagggatttttttgttttagttttttaaagtgcggggattatcggcgtgagttatcgcgtttcgtttgtttttaatttttagtagttttaaattttttggtaatgagtaatgttatagtgttttagatgtttggttttttaagaaaaggatagtaggacgggttatttcggtgggagcgtgttttatttttgtttttcgttagtcgttttcgtcggggatgtatttaggtattttttttcggatgcgtgagtggttcgttcgcggatacgttagtttcgtttcgcgagttcggttttttcgtttttttttcgtttacgttttgcgttttttttttattggttttatgtcgcgttttttcgtttaatcgtagcgtttagcgttagaatttgaattttcgttttcgtttgaattgggcgggcgcgtcgggttggaagaaggaagtggagggttgacgttgcgggcgggcgggcgggcgggaggattcgattcggtgggagtcgttagagtcgggcgttcggggacgtagtttgtagggttatcgggttttcgttagaggcggcggcgggagtagcggggattgtaggtcggggtgtagcgaacgtttttcgcgggttgcggttcggtgtgtgcggagcgtggcgggcgtagtttatcgggtcgaggtgagcgcggcgtcggttttttttgcggcggattttgggtgcgatttgacgagcggtggttcgataagtggttttgcgggtcggatcgttttaggtgagttgcggtcgggatttttgggagttgttcggggtcgagggttgagtcgcgtgttattggttgtaggtaggcgtttgaagatattgtgcgttttcgggtgtttttatagtgggtatttttggttattggggatatagagaatgaaggaaggaagttatatatttgttttttggttttttgtggtaataggaaaatgggatagaaagtttttttgtttggaattcgagaacgtttttttttatattgttgttttgtttggtggtggtaataattttgtttttgtataataggtatagttgttgatagtgttttattagtttttgatatgtgttttattagaggtttgagaaggggggttatttttcgtgtggttattttttagattatacgggatttaggttttattttgtttttttaattttatttcggttttattttgtttttttaattttattttttattttgtttttttcgtttaaggtattttaagtttttgtttattttggtattttttatatatttggaagtttataatgggaaagttttttttttttttaagtttgtgtgatttttattatttaggtattaggtgaaatgttatttttgaggaagttttgtatgaaaatttgtatttttaattttatagttttaggggtgagttgtgggtttgttttttattaggttgagttttttaaaggtaaagattgttttgttattaattacgtgtgtagggttagggatggtgtttggtatagggggtgtgattaatatttagtattttggtaagggttagtagaaatatgggttggagttatggatttgtaattttttgagaatagtggtttttataggagggttatttaattttttaggatttatttgaatttttatgttata

SEQ ID NO: 94 - DNA, 5908 bp, Artificial Sequence
  chemically treated genomic DNA (Homo sapiens)
tgtgatatggaaatttaaatgaattttggaaggttagatgatttttttgtgagaattattgtttttaagagattgtaaatttatggttttagtttatgtttttattgatttttgttagaatgttaggtattgattatattttttatgttagatattatttttggttttatatacgtgattagtaataagatagtttttgtttttggggagtttagtttagtgggagataaatttataatttatttttgaagttgtggggttggaaatataagtttttatgtaaggtttttttagaggtgatattttatttgatgtttgaatgatggaaattatataagtttgaggaaggggagaatttttttattgtaaatttttaagtgtgtaagaagtattaaggtgaataaaggtttggaatgttttaggcggaaggaataaggtaggggatggggttgggaggatagggtgaggtcgggatggggttgggaggatagggtgaggtttgaatttcgtgtggtttgggaaatgattatacgggaaatgatttttttttttaggtttttagtgggatatatgttagaggttgatggggtattgttagtaattatatttgttatatagggatagggttattattattattaaataggatagtaatataagaggaaacgttttcgaattttaggtaggaagattttttgttttatttttttattgttataaggagttaagagataagtgtatggttttttttttttattttttgtgtttttagtggttagggatgtttattgtggaggtattcgggggcgtatagtgtttttagacgtttgtttgtagttagtgatacgcggtttagttttcgatttcggatagtttttaggagtttcggtcgtagtttatttgggacgattcggttcgtaaggttatttgtcgaattatcgttcgttaagtcgtatttaaagttcgtcgtaggaggagtcggcgtcgcgtttatttcggttcggtaagttgcgttcgttacgtttcgtatatatcgggtcgtagttcgcggggggcgttcgttgtatttcggtttgtagttttcgttgttttcgtcgtcgtttttgacggggattcggtggttttataggttacgttttcgggcgttcggttttagcggtttttatcgagtcgagttttttcgttcgttcgttcgttcgtagcgttagttttttattttttttttttagttcggcgcgttcgtttaatttaaacgaaaacgaagatttaaattttggcgttaagcgttgcgattgaacgggaaagcgcggtatgggattaataggaagggagcgtagggcgtgggcggggagggggcggggaaatcgggttcgcggggcggggttggcgtgttcgcgggcgagttatttacgtattcggaggaaaatatttgggtgtattttcggcgagggcggttggcggagggtagaggtggaatacgtttttatcgagataattcgttttgttattttttttttaaaggattaaatatttgggatattataatattatttattgttagaagatttaaaattgttaaaaattaaaaataggcgggacgcggtggtttacgtcggtaattttcgtattttgggaagttgaagtaggaagattttttgagttcgggagtttagaattagtttgggttatttggagagaatttatttttataaaaaattcgttaggcgtggtggcgtttttgtagttttagttattgggatagttgaggtgggaggatcgtttgagtcggggcggtcgaggttgtagtgagttgagatcgcgttattgtattttagtttgggcgatagagtaaagttttgttttaaaaaaaaaaaaaaaaaaaaaaaaaaaatcgaaatttttttttttagtgtatatattttattaaatataaaaataattaattatataaagtagtttggtgtgtttttttttgttatacgtgtatttttttttttaaaagtatagaaaaaaaggttataatatatataatacgattttatattttgtgttttttgtttttaaatattttgaggttatttttattgaatatattttcgtttttattttttgatggttgtagagtattgggtttcgggaaattataatttatttaattattattattgttatatatttaggtttataatgttttgttattagaaaatattttttaattgaaatggtttgtgtatgttaagatgggtgaattttaaaataattttatataggattttatcggggtttgttttagttgcgttggtggttatgtgggtttagtaggttatttggggtgaagtgaatggagtttaaatacgtttttggtgataacggtttttttgttttattttattttttttagttttttagtaatttttggagtttggtttttttgattagggaggtttcgatgtaggggatttttgaggattttttattttttttagagagtttataaggttaaaattatttatttaatgattttttgtgttatttgttttttttatttttatgtttttaagagtgtggggtgtggttttgtaaatgtagaagtagtgaggagatttttattgttttcgttttaattaggtattatagagatttgtaaaaatgtgaattaaagcgttgtttttattttgttgttttttttttataaaaataagttattggtgttagtatgaaataggtgtattattattttaaaatgaattaataaatgaatatttttaaattttttagttttaattttaaatatataaatatagttagatataatttatttatattaataaaaatttttggtggtttttaataatttttaagagtgtaaagggattataagattgaaaagattgagttttttgttttagagtaattataaagatattagttgttgatggaaatagagaaattgggaaagtaatataaaagtataggatagtaattttaaattgtatgggttaagtttgacgtagaaaaatttagtgcggggatattattatataaacgttttagggggtatgagtttttatgtttttttttattaaacgattaaataaagtttattattgtataattttataaaatataattttttttattttaattattgtttgtttttagagatagtttttttatttttatggatgtagtttaattagaattagaaggtgttaggttaggcgtaggggtttatgtttgtaattttagtattttgggaggttaaggtgggtggattatgaggttaggaatttaagattagattgattaatatggtgaaattttatttttattaaaaatataaaaattagtcgggtgtagtggtatacgtttgtagttttagttattcggaaggttgaggtaggagaattatttgaattcgggaggtagtggttgtagtaagttaaggttacgttattgcgttttagtttgggtaatagagcgagattttattaaaaaaaaaaaatagaaaagagagagagatagaaagaaagaacgaaggaaagaaagaaagaaaaagaaagaaagaaagagagagagaagaaaaagagaggagaaaaagaaagaaagagagaagaaaaaggaagaaagaaagaaaaatattttgagttatttttttgaaatattttgagttattttttttttgttgttgttgttgttgttttttttttttgagatgaagttttattttgtttttcgggttggagtgtagtggtgtaatttttgtttattgtaattttcgttttttaggtttaagcgatttttttgttttagttttttaagtagttgggattataggtgtttgttgttaagtttagttattttttttttttgtatttttagtggagatggggttttatttttttttttttgagattgagttttattttgttatttaggttggagtgtagtggtatagttttggtttattgtaatttttggtttttgagtttaagtaatttttttgtttcggttttttgagtagttaggattataggtgtgagttattacgtatagtttatatatatatatatattatgtgtgtgtgtatatatatgtatgtgtgtgtgtgtgtgtgtgtatatatatagtatattgtcgttatatatatgtatatatgtatatatatgtgtgtatatatatagtattttttttttatatatagtatatagtatgtgtgtatatatatagtatattgtatatatagtaattatatatagtatatatattatatataataattatatatagagtatatatattatatataattagtatatatattattatatatatatatatatatatagtatttttagtagaattaggttttaatatgttggttagttgtatcgattttttggaggagggagaggaggtgagttttgtgattggatgagttatttttggagtaggtattgtgaagtttttagaagaggaattaatttggatgtgttttgatcggtgaagatttgttttagttatagggggttttgtattagtttatttgttcgtatatagattaattatttggataaaagggaattagggtatagattttaattttttaattttagagaaaggtagtgaaataaaatataatattaaaaagtatgggtttatgagtatatatgtatatttgtttttattaaaaagaagttataggaagataaattatataacgtaaatatggagaagggaggggatagggatagaagtttagtttttttgaattgttttttttggtagatttgatttttgagttttataaatatttatataaatataaaattaattaaattaataaagataaaaagaagaaattttaaaagtagaaattaaaatataattgtgtattatgtagtaatatagttttatagagaggaataatttagttattttaaatatattaatgtaagggtatttttttagatagatattttttgaggataaaatgaattgaaaattaagattaattagtttttaagaattgtgttggtagtgatattgatgtttttttgaatttatatattatgataggatgaggtaaataagcgattatttgaatattattaggaataggatttttttagtttaagaaaaaaggaatataaagttaaaaagttgtgttttgtggttattgtgtaaaagtagaagggggtttttatttaaaatttggtttgggtattaggattgatggtgttatatatttatttagagggtatgggaagggttattatttatataattgagttttttggggtaatagataggttttttaagagggtgtgaaatggtttgagaaagtagggaaggatttggtttgtggttagggttggggtttgttgagagttggtggtagggtttttgtgggttgaggaagaagttgaagtttttttattagtttgtttagatgtggggttggggagtggggagagggaaggatgaggttttaaggttattagtagtcgaatattaaatattagaaatggagtttgattttttatggtatttagtaaattttgtattgagaatgttaggatgaatttatggtgtattattttttaaaatttaaaataaaatagatttttttgtatatttattgaagaggttttgaatttattttatagttatgagtgtttttatattttagattatgattttgaaaattattttttattaaaaggagttaagtttttttgtagaaatggtggattttagattcggagtaagaaatttataggatgattttggagtattttgttatattaataagtaaggatgttttaaaaatataaaaataaaaatttattgtgattatgtttgaaggatttaggagttaatttgaagagatttttttttgtttaat

SEQ ID NO: 95 - DNA, 15732 bp, Artificial Sequence
  chemically treated genomic DNA (Homo sapiens)
aagagagaaataaaaatgaaagttcgattttaattatttaatttaggtgaattttttgtatgttcgattgtatttagtttagtttaattaatatttattgattattttaatttatgttaggaaattgatgatataaagaagataaataattaatgatgattttagttattgatgttttaatatagagggggtatataaataagtgaaaagaaaattttaatgaaatgtagtaaatgttaagatataggaacgtgtagagtattatagaggtatttaaaggtgatttgtgataggtatggatagtttttaaaggaagagtgagttttaatataattatttgaagaaaatgtggatagtagagtagaaaatgtatgaggggaattttaggatgagagaagatgattaaatttattaagttatgaaataataatatgtgtgaaataatattatgtgttagagatatggagaaattaaattgttagttggtatagtaggataagtagagaaaagatagagattagtaagaaatgaggttagagaaataaagatatattaggttatgaaggtttttgagtattaaataaagaattattttatttaatgagtaatgtatgtaatgttggagaatttaaagaagtgaaattaagtgattaatgagttagttagaatagttttagttttaggtaatataaatttttaagttaaatgatttaaaaagtaggaaatttataagaagattttttgtttggggagagaagagggatgttagttaatttattgatttaataatattttttatgaaatattttttttattgtatttaatttaattgttttagtttattttaaatgaaaatataaggatagttggaataaataataagttattttttttagtttatgttttttgtttagtaaagaaaattttttttagatatttttttattgtaggtttttatttagatattagtggttaaaattgggttatatgtttatttttaattaattgtttaaaaaggatttagtttttttgattgatttaagtaaataattatttattttttggagttgaaaaatattagtattttataaatattttgataattaatatttgagatggaagggagtattgtgtgagtaaaatataaatagataattatagaatatgttattatttattttttgtaatatattttttgaaatgttgtagggtagattttagaattttaggttggaagaaaggaggtgagttagaatagtaatgattttagtaagagatagtgagaatttgaattagaaaagtgggaaataaatatttgggaaatatttatgagataaaattattatttgagttagtagtttgtgcgttgtttggtggagaattaatagagggtatcgttataaaagttagtttttaaaaaagggtatgtattagtttatttttattttgttgataaaggtatatttgagattgggttttttattaaaaataagaagtttattggatttataattttatatggttggggtggttttataattatagtagaaggtaaggaagcgtaagttatattttatatggatggtagtaggtaaagagagagtttatgtagggtaatttttattttttaaaaatcgttagattttgtgagatttatttattattatgagaatagtatgggaaagatttatttttataatttattttttttttattgggttttttttttaatatgtgggaattgtgggagttataagatgagatttgggtggggatatagagttaaattatattattttatttttggttttttttaaattttatatttttatattttaaaatttattatgtttttttaatagttttttaaagttattaatttaaaagtttatagtgtaaagttttatttaagataaggtaagttttttttatttatgagtttgtaaaattaaaagtaagttagttattttttatatataatggggatataggtattgggaaaatatagttattttaagtgggagaaattggttaaaataaaggagttataggttttatgtaagtttaaaatttagtggggtagttaaattttaaagttttaaaatgattttttttgatttttttttatatttaggttatattgatgtaagaggtaggtttttatagttttgggtagttttatttttgtggttttgtagggaatagttttttttttgattgtttttataggttggtattgagtgtttgtggtttttttagttgtatggtgtaagttattagtgtatgtattattgtggggtttggaggatgatggttttttttttataattttattatgtggtgttttggtagggattttgtgtagggtttttagttttacgttttttttttgtattgttttagtagaggttttttattaggatttcgtttttatagtaaatttttgtttgggtatttagtagtttttatatattttttgaaatttaggtagaggtttttaaattttaatttttgatttttttgtatttttaggtttaatagtatgtggaagttgttaaggtttgaggtttgtattttttgaagttatggtgtaagttttatagtagttttttttagttattgttgaagtggttgggatgtagggtattaagttattaggttgtatatagtatagggattttgggtttggttcgtgaaattattttttttttttatatttttaggtttgtgatgggattggttgttatatacgtttttgatacgttttggagatattttttttattgtttttatgattaatatttagtttttttttatttatgtaaatttttgtagttggtatgaatttttttttagaaaatgggatttttttttttattgtattattaggttgtaaattttttaaatttttatgttttgttttttttttaaaattgaatgtttttaatagtatttaagttatattttgaatgtttttttgtttagaaattttttttattagatattttaaattattttttttaaattttaagatatatatttttaggttaggggtaaaatgttgttagtttttttgttaaaatataataagagttatttttgttttagtttttaataagttttttatttttatttgagattattatagtttggattttattgtttttgttattattagtatttttgttaaagttatttaataagtttttaggaagttttaaacgtttttatatttttttgtttttttttgagttttttaaattgttatttgttatttgttatttagttttaaagttgtttttatattttttggtatttttttagtaatgttttatttttggtattaatttattttattagtttgtttttatgttgttgataaagatatatttaagattgggtattttataaaagaaagaattttattggatttaatgttttatatggttggggaagttttataattatggtggaaggtaaggaggagtaagttatattttacgtagatggtagtaggtaaagagagagtttgtttagggtaatttttattttttaaaaattattttaaaacgattagattttatgagatttatttattattatgagaatagtatgggaaagatttgtttttataatttatttattttttattaggttttttttataatacgtgggaattatgggagttataagatgggatttgggtgggaatatagagttaaattatattagggtagaaagttgttttgaaatatggtaatttttgtcgtgagtttttttggtttttaaatattgaagtggggtatttgataaggtttttttgtgtttttttttattttttattttaagatttgttcgaagtattagtataagagagaaattgaaataatgaatatttatatgtgttagtggttgttattttagatttttttggttttttttgatttattttgttttagtggggtttagatagtttttaaatttaaattttaattttttttatgttgttggtttggattaagataattagttttatttttttttgtagatggttttggattatttttttttattagttgttttgggatttttttttagttatgattatattttgtttatagattagttagttggtaattatagtattgtttgttaattgatattatttatttgataatttagagttatgatattttgtagtgtatttattgttttttataggaaaaaaaaattgtagtataaagggtttattaggttttttattattttagagttttagtgttgttttagaatgtttaaggttttagttatgatatgaattaattatttataaataatgtaaaaagtatgagtaattatgaatttaataattaaggtaaggtagtttagttattatatttaagagagtaattagtatgaaatttttttaaattatttgaataaggatttatatatttataatgattttttgtttttgttaagttttaggtgtattagttattaataattgggtgaatatgtaggtattatttaaataaaaataattttatagtagatttatttttatttaagagatgaagttaagttttggtagtaatagatatttttattaagattttttgtttttgttattttgtgaataggaaaggagggagaaattttggtgttttgttttttttaatttatattaagatttttatttaagcggttatcggtttttaatgatttatatgtaagttagttttataagaaagttttgagtttgaaattttttttagtaagtatttgtaagttaaaaaagcgaagaagaggtattatttattgttatttttttttgtgattgagattatttattataaagaggaattgattattttttttgatatttgaaatagaaagttataaaggttgataggcgtggttttaaaattgttttatgattatataatttttttttagttaggaattaggatagtgtaagaaggttatttataattaagattgagagtggttttaataagtgttatttttttttgttagtttttattttttagttttttataagattaaaatagtttgtagtttaatttttttaaagttttacggatagtgattttgttttaaataagatagtgattttaggatttttgaagattattgtggaagaagtatttattaaggtgagatttttgggaagttttttagagaaagatttaggtatttagttggtaattatattattttagtagagaataattgtttgagattagaagtgttgttattaattatatttagaaaattgagaattgaatgttttaattgtttaggtagtaaatggatattttttattttattataattggggtatgaattaaaaaaatgtattttgtttatagtaagttttaaaaattaatttttgggtgttttttggtataaattgatatttagaggagatatttggtttttttggttggaggatgatttggtgattgggtttgggtttaagttaaaagataagatagttagataagaaaattattatgaagtaatatttagtaaaaaataaattaggatataaatttttattatatgattttatttttattttaaaaagtatagatatgtgtatatattaattttttaattttataagtatttatttaaaaataatttttatatttttatgaattagttttattttatgttttattttataataagtgtaagaagaaataatttttttttttaaatggtttatgttttatttagttatagataatattttttgtggtaaggtataatgaaaagatagggagaattaattatatattttttattttgggatatattttgatttttttatggttttgtatatatgaatgttttttaattattttatgagtatttgagaagagtttataaacgttggattttaaattttatttaagtaagataaagttttttaagtaagtttgttaattatgtttgaaaaatttaaatttaaatttaagttattttttattttgtttttttagtaattgagagatgtggtgaaatttttaattttaatagtgattttgttaattttttattgtagtttttttgatttttattatatatttttatatagaatatgtatatttaagtatatatgttatgtgtgtgtttagagagaagaaaaaatttttatatgttattttataaagtaataatagattatatttataatataatttaaattattatatttttttttaagttgtatattttattattatgtagtgaaattatgtattgatatttattgatttaagtttattttaagttatattattttttttaaaaagtttttttttaagttagagtttgaagaatataatttttttagtttttttttaaatttaagtgaatttatgttttatttgtattttgttaataatatatgattggatttatttttaatttaaattgaaaatttttttttttagttgatgagtttagtttagatatgtaaattttataaaggtatatattttaatttggttttgttattttattttgttttaatttatagtatttattttgtgttttttttttttttttttttgttaagttttttatttttaaaaaatttatattttttttaaagataagttttttagtaaatttttatattttttggttttttaaatatataattttatttgttaagagtatgtttatatagtttttgtttttttttatttgattttggttttatttatttttaagatagtaaaaatattaattaaagtatttgtttgatttttttttttttttggtttttaatattttttagatttatttttttttataatgagtagttttttataaagagttgtgggtatggatatttttattgttaagtttttgaaagttttgaatataataattgtttttttttaattgtgttaagaaatatgtaatataaaatgtgttattttaattagttttaagtgtatagtttagtagtattaaatatatttatattgttgtgtaattaatttttagaacgtttttgtattttgtaaaattaaaattttaatcgttaattaataattttattattttttttttttttagagtttggtaaatattattttattttttttttttataaatttaaaaattttaattttttatatatgtttaattatatagtaagcgtgtgttttttgtgattggttttttttattttatgtttttaaagtttatttatgttgtattgtattatgtgttagaatattttttttttttagggtagaataatattttattttatgtatttattataaaatacgtaagaaattatatttttttttatttatttatttattgaaggatatttgtaatatttttatatttttttgttgtgattaatgttgtaatgaatatatatgtatatgtatttatttgagattatatttttatttattttgggaatatatttagaagtgaaattattgaattatatggtaatgttatttttaattttaagagtaagaattatattttttttatagtatttgaattattttatatttttattaatgatgtataaggttttttttttttatttatttttattaatattggttattttttgtagttatttttttgatagtattaaaaaatattattttaggagtttcgatgttttgtgtatgtatgtttttaattgttatattttattgtggtttttatgggtttgatttgtatttttttaaagattattgtcgttgagtatatttatatgtgtttattggttatttgtatagtatttttgaagaaatgtttatttaagttttttattaatttttttttttttttttttgagacggagtttcgttttgtcgtttaggttggagtgtagtggcgcgatttcgatttattgtaagtttcgtttttcgggtttacgttatttttttgttttagttttttatgtagttgggattatagatacgcgttattatgttcggttaatttttgtatttttagtagagaaggggttttatcgtgtttattaatttttattatattgtttggattttgttgttgttggagttgatttgtaggagttggttgtatattttggatataaagtatttattaaatatataaagtgtgaatatttttttttattttttaggtttttttttttattttgttaattgtgtttttgatgtatataaaaattaaatgttgttgtagtttaatttatttattttattgttgttgttgttgtttgtgttatcggtgttatgtttaagaaatttattgttaaatttaatgttatggagttttttttttttgttttattttgagagttttatagttttaatttttatatttagatatttgatatattttgagttatattttgtatatgatgtaggtaagggtttaattttttgtatatagatgttataattgtttaatagtatttttgaaaagattgttttttttgattaaatagttttgacgtttatgttaaaaattaataagttatattttttagggtttatttttatgttatttattatattttattgttttttatgtttgtttttatgttaatattatattgttttgattattgtgtttttataataagttttgaaagtaggaagtttgaaatttttatgtttttgtttttaagattaaaaaaggttatttaaagtatttttaaattttatatgaattttaagataaatttttgtgttcgtgtaaaaaatatttttgggattttgtattatagattatattgtaaattgtattgtatatgtagttttttgggtattgatattttaatagtattaagttttttaatttttggatatagatgtttttttatgtatatttgtgttttttttaatttttttaaagtgttgtataatttattattttgattaagtttatttttaagtattttattattttaagttattgtatatagaaaaagaattgtttttttaattttttttttgttcgttgttagcgtataaaaatataattgatttgtatgtgttgtttttgatttttgtaattttgttggatttgtttattaattttaagtatttatatagaatttttgggattttttatatataagattatattattagtaaagagagagaatttatttttttttttttttatttggatattttatattttttgtttattgtttatttttggtgggggggggggtgggtgttaaatttttagtattattttaaatagaagtgaataaaaaaattatttttgttttttttttgatgttttaggagtaagagaaatgtttttagttttttattattgggaataatgttagttatggtgttttcgtatgtagattttattatgttgaagtaatttttttttatttttcgtttattgagtgtttttaatatgaaaggttatttaattttgttaaatgttttatttattttttgtattaattgagatgattattttttttttgttttttattttggtaatgtggtgtattattttaattgatttttataagtgaaaaatgagtatttgtgtatttttttttattttttaggaataagagaaatatttttagttttttattattaagagtgttaattgattgttgtatggtgagttattattgtattttagggataaattttaaatggttatgatgtataaataaatttaacgtgttatataattatgttcgttagtattttgtaaaaaaaaaatgtatcgatatgtataagggatattgtttagaaaattttatttttttagtgtttttgtttggttttgtattggagtaatgttgagttatataatgagtttggaagtgtttttttttttttaaattttgaaagattttgaggaattttggttttaatttttttttatatatttggtagaatttattagtaaaattatttagtttggatttttttttattgagaggtttttgatttttgatttagttttttgattagttataatgattgttcggattttttatttttttatgatttaaaatttgtaggttgtatgtttttaataatttatttatttatttattttatttaggttattttatttattgatgtataattgtttaaagtattttttttatttttgtgaaatttgttgtaatgttttttttttagtttttgattttattatttgagttttttttttttttttttatgttaatttagttaaagttttgttagtattatttatatttttagaaaattaatttttttttttattgattttttttattatttttttaattttaattttatttttaatttttattttttttttttttttgatggtttttggtttagtttgttttatttttttaagttttttatggtgtaaagttagattattgatttgagagttttttttgtaaatgtagttgtttaaatttgtaaattatttttattattatattttttgtatttaatgaaatgatatgttgtgtttttatataatttttttaaatatggatttaaatttgatttgtgattttttgtatatgttttattgtttgtgttgtttatttttatagggttatgaattttttagttttttttttgttgatttttatttttattttattatgataaaaaaatatattttgtatgattttaaacgtttaatatttattaatatttgtttggtattttaatttgtggtatatgttgggataatgttttatatgttcgtgtgaaaaatgtgtattttattgttgttggttttattgttttggatatatttgttagatataattggtttataagtggtttataatgttttttaatatttattttttttaaatttttttttgttagattgttttatttattattgaaagtggaatattaaagttttttattattattttagagttgtttatttttttttttaattttgtaaatgttttatatattaggagttttgatgttttgtgtatgtatgtttttaattgttatattttttaggtgaattggtttttttaatattatgtaatattttttgttttttataatattttttgattgttatttttattttatttgattttagtatagtaaattttgtttttttatttaatattttaatggaatatattttttatttttttattttttatttttgtttttatatttgtaaaatgagttttttgtatgtaatatatatttggattttttgtttttaaatttattgtgatatatatgtatatataattttaatatgttttttgattagtaagtttaaattatttatatttgaattaattattgataaggaagaatttagaatttattgttgttattttttatttgttttttgtatgttttaataggtttttgttttttagtgatttttttttgttgatttttttttgtagtgaaatatttttatgtttttttatttttttgtgtatattttatagatatttttgtggttattattaggttgtatatgatattttaaagttatagtaatttatttttaattaataataatttaattttaattatatgtaaaatgtttatttttttatagttttttaatatatattttatgttaatattataaattgtatttatataatatgtattaattaatattgatttataaattgttttgtttttatattttaaattttataaaataataaaaaatgattataaattaaaatagtaaaagttatgttttatgtttatgtatatatttattttttattaagaatttatatttttgtatgagtttgagttattatttagtatttttgtgttttagtttgaagaaatttttttagtattttttttaaggtagatatagtggtaatgaaattttttagtttatgtttatttgggaatgttttaattttttttatttatgaatagtaggttttttagatatagtatttttggtggatagatttttttttaaatatttgaaatgtattgttttattattttttggtttataaagtatttgttgaaaaatgtgtttataattttattgaagattttttggatataatgagttgttttttttttgcgttttttaaatgatttttttttcgtttttgagtgttggtaatttgataataatgtgttatagtgtaagtttttttgagtttattatagttgtagtttgtttggttttttatatttgtatatttagtttttttttaaatttggaaagtttttagtttttatttatttaataattttgttattttttttttttttttattatttttttagatttatataatgtatatattgttttatttgatgaattttataagttttgtttatttttttttatattttttaaaaaagtttgttttttagttttgataattatatatgatttgtttaaaagttaattgatttttttgtttattggtgtgggttgaggaatttttttagtggattttataatgtagttaatgtgttttttagttttagaatttatggaattttttttggtaatttttattttttgtttatttttattttttattaattatttttttgattttatttagttgtttttatttatttttttttaatttatttattatatttaagagtgttgttttagtttttgataagaaagtttgagggttgtgtttttttagagaaagtttgtggagatttatttttttttttaaaattgattatgtttatttgtttttttgtatattttttgttgaaaattggatatttgtaaaaatagtttttttttaattattgttaattggtattatatttaggggaggatttttattttttagttaagtatgaaatataaacgttttttgaggtttatatggacgtgtgttttgtttgggtttatgtgtgtgtattttttgtaatttttttatatatatattgtttttaatttgtaatttttttaagagttatatttgtttttttttatgattttagatgttttattgtatttttttatttataattttttgttttttggtatttagggagtagtagattttatgaagtttttataagttggagtatttattattattttttgtagttttaaatttgatatttaaattatgttattatttttattaatgttttaagttatgtgaagtagttattagttttttaaggaatttatagagaagttataatgttgtaaagtagttttatatttttttttttattttaaaggaagaatgaggaattaggaagtttttttttgattacgttatattatttaagggagaaagttaaatagggataaagaaaaatatttagaagttttttattattttgaatgtggtttaattttggtttggaattttttttgttgtaattaatttttaatagttgaaaatattagtttggtttaaaaattgttttttatttggtgtttttatggtataatgaaagtttggaacgtttttgtttgtaattttgttaatgttatttttagtgagaagagaataattttttaaattataatatttaaataatattttgattagatataaaattttagtttgaaaaatatttttgtttgaaaattgatttatagtattttatttgaaatttttgggataattttgatttttaatttatttttttagggggggattttagaaagattatttaatgtatatattgtatgtaggtattgtaagtgttttagtagaggtaatattaatattttaatattaaatgtattaagagttttttaataaattatgttattatttatattaaagtgagatgaataaggaagattaaaaatagttattgtattagtttttttttacgttgttatgaagaaatatttgagattgggtaatttataaagaaaagagatttgatttatttatagtttcgtacggttggggagttttaaggaaatttataattatgatggaaggtatttttttatagggtggtaggagagagaatgagtgttagtaggggaaatgtttgatgtttataaaattatagattttatgagaatttgtttattattataagatgatattttaagatgagatttgggttgggatatagttaaattatattagttatgtattattttatattatatttttaatttgtaagatgattttgttattatatttttttgttaatttttatttttttttaagtttttaaatcgtataaatttttttattttttagtatttttttaggttttaaaattgtagatatataattatggattagtattatgtaaaaattatttttttaatttgttgtagattgtttaattagattatttaatttttgtaggtgttttatttagtatttttggaagattttattattttgtttttaatattttttggttttattatatgtgtttatgtgtgaaatttttttttatttgataggtttaaatataggaatatttatgtttttttaaaagagaataatttatagttttaagaatttggatattttaattatataaaagttgtataaatatatggttattaatttaaaggaatatttataaatttaaatagaaaattggaatatacgttaggaattgaatgtttttaggtagtatataaggggttaaagaggtatatataagtgagagtgggattataatagttcgtagaagataaagttttaattaagtattaaaaattttaaggaagtatttagaggaagaaaattgggaatgtttttttagatagtaggaagggaattagtagtaagaagatttgaaaaagaaagatatattgtgtatttttagagtataaggtataagaaatttaaaagtaatagatatatataaaaagaaagatatagtttatgtaaggttttttaagttatgttgagtagaaatttatattaataaaaattaaaatttattgaaggattttaggaaaaatagagttatgtttttatttataaagaaatttatttggttgtttgatagaaattttttagtaaaagtaagattagttggaggtaaataattgattgtaaaaaataaatgtgtaaaaaataaatgttgtaattttatattagagagtagataggaggatggtaaaatgataattttatagatgtataggatatagagaataagttttaagttttagggagaaaaagtgttaacgagagttgattagggagagttaagaaggattagagtttattttataatttagaattgtagtgttgtggtagaaggttatttatataaggtgagtggttgtagtttatttatatttaggttattttggttatagtggataagggaagaattaggaattaagaggtaggtattgagggataggtttaggttttaataaaatattagaagaggaattagggattttgatattataaaatttatattataaatattgtaataattatttgtttttaaatattattttattatatatatttttgttttaatttattaatattaaaagggaagaattttattgaattttttaataaagtaagttttgatttattgtttatagtgatatatttggtaatttagttttttttttttatacgtatttaaggataatattttggtttgggatatttatttataaaagtatattttattttttaaaattgtttgtataaatgtgtaatgttgtgtgttatttttattttatagg

SEQ ID NO: 96 - DNA, 15732 bp, Artificial Sequence
  chemically treated genomic DNA (Homo sapiens)
tttataaagtaaaaatgatatataatattatatatttatgtagataattttaaaaaatgagatatgtttttgtgagtgagtgttttaggttaaaatgttgtttttggatgcgtataagaaaaagggattaagttattagatatgttattgtgaataatggattaagatttgttttattaggaggtttagtgaagttttttttttttaatgttgataagttgggatagaggtgtatgtggtgaaatgatgtttggaaataggtaattgttgtagtatttatagtatgggttttgtggtgttaaagtttttggttttttttttgatattttattggggtttgagtttattttttaatgtttattttttggtttttgattttttttttatttattatgattaaagtggtttaagtataaatgggttgtagttatttattttatgtgaataattttttgttatagtattatagttttgagttgtggaatggattttagttttttttggttttttttaattagttttcgttagtattttttttttttggggtttagaatttgttttttgtgttttatgtatttataaaattgttattttgttatttttttatttgttttttagtgtggaattgtagtatttattttttgtatatttgttttttatagttaattatttatttttaattagttttatttttattaaaaggtttttgttagataattaagtaggtttttttatggataaagatatgattttattttttttgaaattttttaatgagttttgatttttattagtatagatttttatttagtatgatttgaaaggttttgtataaattgtatttttttttttgtgtgtgtttgttatttttgaattttttatattttatgttttagaaatatataatatgttttttttttttaggtttttttattgttaattttttttttgttatttgggaaagtatttttagttttttttttttgaatatttttttagagtttttaatgtttaattgaggttttattttttgcgagttgttgtggttttatttttatttatgtgtgtttttttaattttttgtgtattatttaagggtatttagtttttaacgtatattttaattttttgtttaaatttataggtatttttttaggttggtgattatgtgtttgtgtaatttttatataattagagtgtttaaatttttagggttgtaaattgtttttttttgggagaatatgagtgtttttgtgtttaaatttattagataaagagaaattttatatatgggtatatatagtaaagttaaagaatattaaaagtaaaatgataaaattttttagaaatattgagtagaatatttataaagattaaataatttgattgaatagtttgtagtaggttaagaaagtaatttttatatagtattgatttataattatatgtttgtaattttaaaatttaagaagatattgaaggatgaaaagatttgtgcggtttgggggtttgggaagggatgagagttagtagggaagtgtggtagtaaaattattttgtaaattagagatataatgtgaagtaatatatggttgatatggtttggttatgttttaatttaaattttattttgaaatattattttgtgatagtgagtaagtttttatgagatttatggttttataaatattaggtattttttttgttagtatttatttttttttttgttattttgtgaagaggtgttttttattatgattgtaagtttttttaggattttttagtcgtgcggaattgtgagtaaattaaattttttttttttataaattatttagttttaggtatttttttatagtagcgtgagaaggaattaatatagtggttatttttaattttttttatttattttattttaatgtgaatagtggtatgatttgttgaagaatttttaatgtatttgatattaggatgttgatattatttttattgggatatttgtagtgtttatatataatgtatgtattaagtagtttttttaaaatttttttttaaaaaaatgaattaaaaattagagttgttttaggggttttaggtgaagtgttgtgaattagtttttaagtaaaaatattttttaaattaaaattttgtatttggttaaaatgttatttgaatgttatggtttaaaaaattgttttttttttattgagagtgatattagtaagattgtagataaggacgttttagatttttattatattatggaaatattaaataaagaataatttttgaattaaattaatgtttttagttgttaagaattggttgtaataaaggaaattttaaattaagattaagttatatttaaaatagtggaaaatttttaggtgtttttttttgtttttgtttaatttttttttttgaatggtgtgacgtgattaggaggaaattttttaattttttattttttttttggaatagaaggaaaagtgtggaattgttttgtaatattatagtttttttgtaggttttttgagggattagtaattgttttatatgatttggagtattgatggaaatggtggtatagtttaaatgttagatttgaggttgtaaaaagtagtggtgggtgttttagtttgtgagagttttatgggatttgttattttttgggtgttagaaggtaagagattatggatagaggaatatagtagaatatttaaggttatgaaaagaggtaggtgtggtttttagggaaattatagattaaaagtagtgtgtatatgagagaattataaaaaatgtatatatataagtttaggtaagatatacgtttatataggttttagagaacgtttatattttatatttagttgaagagtgaaagtttttttttgaatatggtgttagttaataatggttgagagggggttgtttttataaatgtttagtttttaataaaaggtatataaagaaataggtaaatatggttaattttaaagaaaaaaatgaatttttataaattttttttaaagaaatatagtttttagatttttttgttaaagattaaaatagtatttttaaatatgataaatgagttaaaggaaaataggtagagataattaaataaaattaggaaaatgattaataaaaaatgagaatagataaaaaatagaaattattagaaaaaattttataaattttgaagttgaaaaatatattgattgtattgtaaaatttattagaggggttttttagtttatattaataggtagaagaattagttagtttttagataggttatgtgtaattattaaggttgaagaataaatttttttaaaagatataaaggaaagtgaatagaatttataaagtttattaagtgggataatatatgtattatgtaagtttgaaaaggtgatggaaaagagaaaggaataataaaattattgagtaaataaggattgaaaattttttaaatttgagaaaagattaaatgtatagatataagaaattaaataagttgtaattatgataaatttaaagaaatttatattatgatatattattattaaattattaatatttaaagacgaaaagaaaattatttaaaaagcgtaagaaaaaggtaatttattatatttaagaaatttttaataggattatgagtatattttttagtaaatattttgtagattagaaggtagtgggataatatattttaagtgtttaaagaaaagtttgtttattaaaaatgttatatttgggaaatttgttatttataaatgagagaaattaagatatttttagataaatataagttgaaggattttattattattatatttattttaaaagaaatattaaagagatttttttaagttgaaatataaggatgttagatggtaatttaaatttatataaaaatgtaagtttttgatgaaaggtaagtatatatataaatatgaaatatgatttttgttattttgatttgtaattattttttattattttataggatttaaaatgtgaaagtaaaataatttataaattaatgttaattggtatatattatataaatgtaatttgtaatattaatataaaatatgtgttggggagttgtaaaggagtaaatattttgtatatgattgaagttaagttgttattagttaaaaatagattgttataattttagaatattatatgtaatttgatgatgattatagagatatttgtaggatgtatataaaggaatagaagaatataaaaatgttttattatagaaaaaaattaataaaaagaagttattaagagataaaaatttattaagatatatagaaaataaataaaaaatggtaataataagttttaagtttttttttattaataattagtttaaatgtaaatggtttaaatttattaattaaaaagtatattaaaattatatatatatatatattataatgaatttaaaaataggggatttaagtatatgttgtatataagaggtttattttatagatgtaaggataaagatagaaagtgaaggaataaaagatatattttattgaaatattaaataagagagtagagtttgttatattaggattagataaaataaaaataatagttaaaaagtgttataagagataaagaatattatatagtgttaaaaaggttagtttatttagaagatatgataattagaaatatatatgtataaaatattagggtttttaatatatgaaatatttatagaattgaagggagaaatagataattttaaggtaatagtaagagattttaatgttttatttttaataataggtagaataatttgatagaagaaaatttggaaaaaataaatattgaaaaatattatagattatttatagattaattatatttaatagatatatttaaaatagtaaagttaataatagtagaatatatattttttatacgaatatatggaatattgttttaatatatattataaattaggatgttaaataagtgttaataaatgttaaacgtttgaaattatatagagtatatttttttattataatggaataaaagtagaaattaatagaaagaaaattagaaaatttatgattttgtgaaaataaataatataaataatgaaatatgtataaagaattataagttaaatttaaatttatatttagagaaattatatagaaatataatatattattttattaaatgtaaagaatatggtgatgagggtaatttatagatttaaataattatatttataaagaagatttttaaattaataatttgattttatattataaggaatttaaaaaagtagaataaattaaattaaaagttattaaaaggaaggaaaaaataaaaattagaggtaaaattgagattagaaaaataataaagaaaattaataaaaaaaagagttggttttttgaaaatgtgaataatattgatagaattttaattgaattgatatagaagaaaaagaaggagatttaaataataaaattagaaattaaaaagagaatattataatagattttatagaaataaagagaatattttgaataattatatattaataagtgggataatttaaatgaaatggataaatggataaattattagaaatatataatttgtaaattttgaattataaagaaatagaaaattcgaatagttattatgattagttaggagattgaattagaagttaaaaattttttaataaagaaaagtttagattaagtggttttattggtaaattttattaaatatataaagaagaattaagattaaaattttttaaagttttttaaaatttgaaaaggagggaatatttttaaatttattgtatgatttagtattattttaatgtaaagttagatagaggtattagaaaaataaaattttttaaataatattttttatgtatgtcgatgtattttttttttataaaatgttagcgaatataattatatagtacgttaaatttatttatgtattatgattatttaaggtttatttttggaatgtaatgatggtttattatgtaataattaattaatatttttaatggtaaaagattgaaaatattttttttatttttgaaagatgaggaaaaatatatagatgtttattttttatttgtaaaaattaattaagataatatattatattattagaatgaaagataaaaaaaaaatgattattttaattgatgtaaaaaataaataaagtatttgataaaattaaatagttttttatgttagaaatatttagtaaacgaagaataggagaaaattattttaatatagtaaagtttatatacgaaaatattatagttaatattatttttaatggtaagagattgaaaatattttttttgtttttgaaatattaggaaaaagataaggatgatttttttgtttatttttgtttgagatagtattgagggtttaatatttatttttttttttattaaaaataggtaataaatagaaaatataaaatatttaaataagaaagaaaaaaggtaaattttttttttttattggtgatatgattttatatgtggaaagttttaaagattttatgtaaatatttagaattgataaataaatttagtaaagttataggaattaaaggtaatatatataagttagttgtgtttttatacgttaataacgaataaaaaggaaattaaggaaatagttttttttttgtatataatagtttaaagtagtaaaatatttaggaataaatttaattaaggtggtaaattatataatattttgaaggaattaaagaaggtataaatgtatatgggaaggtatttgtgtttaggggttagaagatttgatattgttaaggtgttaatatttaaggaattgtatatgtaatgtaatttgtaatgtaatttgtaatgtaaaattttagaagtgttttttatacgaatataaaaatttgttttaaaatttatgtagaatttaaaggtattttaaatagttttttttaattttgaaaataagaatatggaggttttagattttttgtttttaaaatttgttataaagatataataattaaaatagtgtggtattggtataaagatagatataaagaataatggaatatgatagatagtatagaaataaattttgagaaatatggtttattgatttttgatatggacgttaaggttgtttaattagaaagaatagtttttttaaaaatgttgttgggtaattgtgatatttgtatataaaaagttgaatttttatttatattatatataaaatgtaatttaaagtatattaaatatttaaatgtaggaattaaaattatgaaatttttagaataaaataaaagggaaaggttttatgatattggatttggtaatgggttttttggatatgatatcgatggtataggtaataataataataataaaatagataaattagattataataatatttaatttttatatatattaaagatataattaatagagtaaaaaagggaatttagagaatgagagaaaatatttatattttatatatttgatgagtgttttatatttagaatatatagttaatttttataaattaattttaataataatagaatttaaatagtgtgataaaaattgataaatacggtgaaattttttttttattaaaaatataaaaattagtcgggtatggtggcgcgtgtttgtagttttagttatatgggaggttgaggtaggagaatggcgtgaattcgggaggcggagtttgtagtgagtcgagatcgcgttattgtattttagtttgggcgatagggcgaaatttcgttttaaaaaaaaaaaaaaaaaaattgataaaggatttgaatagatatttttttaaaggtgttatataaatggttaataagtatatatgagtatgtttaacggtaataatttttagaaaaatataaattaaatttataaaaattataatgagatataataattaaaaatatatatgtataaaatatcggagtttttaggatgatgttttttggtattgttaaaaaaataattatagaaaataattagtgttggtgaggatgagtaaaaaagggaaattttgtatattattggtaggaatgtaaaatggtttagatgttatgaaaaaaatatgatttttatttttaaaattaaaaataatattattatatgatttagtaattttatttttagatatatttttaaaataagtgaaagtgtgattttaaataaatgtatgtatatatatgtttattgtagtattaattataatagaaaaatgtgaaagtattataagtgttttttaatggatgaatgaataaaaagaaatatggttttttacgtattttatggtaaatatatgaaatggaatattattttattttaggaagaaagaatattttgatatatgatataatataatatgaatgaattttgagaatatgaaatgaaaaaagttagttataaaaagtatacgtttattgtatgattaaatatatatgaagagttagagtttttaaatttatggggaaagaaggtagaatgatgtttgttaagttttggaggaaaggggaatggtgaaattgttggttaacggttagagttttagttttgtaagatgtaaaggcgttttggaggttggttgtataataatatgaatgtatttaatattattgaattgtatatttgaagttgattaagatgatatattttatgttatatgttttttaatataattaaaagaaaataattattatatttaaagtttttagaagtttggtagtgaaaatatttatatttatagttttttgtgaagaattatttattatgaaaagaaataaatttaagaaatgttggaggttaaaagggaagaaagattaagtaaatattttaattagtgtttttattattttaaaaataagtaaagttagagttaaataaaagaaaataggaattatatgaatatatttttaataggtgaagttgtatgtttgggggattagaagatgtgagagtttgttaaggggtttgtttttaaggagaatatagattttttaaaaataagaaatttgataagaaaggagaagaagaaagtatagaataagtgttataaattgaaataaagtaagatggtaaaattaagttaaaatatatatttttatagaatttgtatatttggattaaatttattaattaggaggaaaaatttttaatttggattaaaaataaatttagttatatgttgttgataaagtataaataaagtataagtttatttaagtttgagaaagagttggaaaagttatattttttaaattttaatttaaagaaagattttttaggaaaaatagtgtagtttaaaataggtttaagttaataagtattagtatatagttttattatataatggtaaagtatgtaatttggaaaaagatataataatttaaattatattataaatataatttgttattattttataaagtagtatatagaagtttttttttttttttaaatatatatataatatatatatttagatatatatattttatgtaaaaatatatggtagaaattaaaagaattataatgagaaattaataaaattattattagagttggagattttattatattttttagttattgaaagaataaggtaaaaaatagtttagatttagatttagattttttaaatataattaataagtttatttaagaaattttattttatttaaatagaatttggaatttaacgtttataaattttttttaagtatttatggagtaattagaaaatatttatatgtataaagttataaaaaagttaaaatgtattttaaagtaggaaatatataattgattttttttgtttttttattatattttgttataaaaaatgttatttatgattgagtaaagtatagattatttgaaaaagagaattatttttttttatatttgttgtaaaatgaagtataaaatgaaattgatttatgaaaatgtaaagattatttttgagtaaatgtttgtaaaattgagaaattaatgtgtgtatatgtttatgttttttaaaatagagataaaattatataatagagatttatattttggtttattttttattaaatattattttataataatttttttatttgattgttttgttttttaatttaggtttaaatttagttattaagttattttttagttaagaaaattaagtattttttttaaatattaatttatgttaaaagatatttaagaattaatttttaaaatttgttgtagataaaatatatttttttggtttatattttaattgtggtagaataaaagatatttatttgttatttagatagttaaagtatttagtttttagttttttgaatatgattgataataatatttttggttttaggtaattattttttattgagatggtgtggttattaattagatatttagatttttttttaaagaattttttagaaattttattttaatggatgttttttttataatagtttttagaaattttggagttattgttttgtttaggatagaattattgttcgtaaagttttggagagattaaattgtagattattttaattttgtaaagggttgagaaatgaaagttaataaggaaaaatggtatttgttagagttatttttaattttgattgtagatggtttttttatattgttttaatttttaattagaaagaagttatgtaattatgaaataattttgaagttacgtttattagtttttgtagttttttattttagatgttagagaaagtggttagtttttttttgtagtaagtaattttagttataaggagaaatgatagtaaatggtgtttttttttcgtttttttgatttataaatatttgttgaaaggagttttaaatttagaatttttttataaagttaatttatatataggttattagaaatcggtagtcgtttgaataaggattttaatataaattgggaaaggtaaaatattaaagtttttttttttttttttgtttatagagtggtaggagtaggagattttggtagagatgtttattgttattagaatttgattttattttttggataggggtgggtttattgtgaaattgtttttgtttaaatagtatttatatatttatttagttattaataattgatatatttggagtttgatagaggtagaaagttattatgaatatgtaaatttttatttaaataatttgaaagagttttatattagttgtttttttgagtataataattgagttgttttattttgattattaaatttatgattatttatgttttttgtattatttatggatagttggtttatattatgattgaaattttgaatattttggaatagtattgaaattttggaatgatagggggtttgataaattttttgtattgtaattttttttttttgtgaagaatagtgggtgtattataaagtattataattttgaattgttaaatgaatggtattagttagtagatagtgttgtggttattaattagttgatttgtaagtaaaatgtggttatgattggaaaaggattttaaaatagttaataggggaaaatgatttaaggttatttatagagaagaataaagttgattgttttaatttaaattagtagtatagagagagttaaagtttggatttggaaattgtttaaattttattaaagtagggtaaattagaaaaaattaagaggatttagaatgatagttattaatatatgtgggtgtttattgttttagttttttttttatgttgatgtttcgagtaggttttaaggtaaagggtaaagaggaatataaggaaattttattaggtgttttattttagtgtttgggaattaaaagagtttacgataggagttattatgttttaggatagttttttgttttgatatggtttggttttgtgtttttatttaaattttattttgtagtttttataatttttacgtgttgtggaagggatttggtggaagatgaatgaattatgggggtagattttttttatgttgtttttatgatagtaaatgggttttatgagatttgatcgttttaaaatagtttttaaaaaatgggagttgttttgagtaagttttttttttgtttgttgttatttacgtaagatgtgatttgtttttttttgttttttattatgattgtgaggtttttttagttatgtggaatattaagtttaataagatttttttttttgtaaaatgtttagttttgggtatgtttttattaatagtatgaaaatagattaataaagtaaattggtattaggagtagggtattgttgaaaagatattagaaaatgtggaagtaattttaaaattgggtaataggtagtaggtaatagtttggaaggtttagaagaagataagaaaatgtgggaacgtttggaattttttagagatttgttgaatggttttgataaaaatgttgatagtgatagaaataataagatttaggttgtggtggttttagatggagatgagggatttgttgggaattggagtaaaggtgatttttgttatgttttggtaaggagattggtagtattttgtttttgatttagagatgtgtgttttagagtttgagagagatgatttagggtatttgatggaagaaatttttaagtaggaaagtatttaagatgtgatttgagtgttgttaaaggtatttagttttaaaagggaaatagagtataaaaatttggaaaatttgtagtttaataatgtaatagaaaagaaaattttattttttgaggagaaatttatgttagttgtagaaatttgtataagtaaggaggagttaaatgttaattatgaagataatggggaaaatatttttagggcgtgttagggacgtgtgtagtagttagttttattataggtttggaggtgtaagaggaaaaagtggttttacgggttaggtttagggtttttgtgttgtgtgtagtttagtgatttagtgttttatattttagttattttagtagtggttgaagggggttattgtagagtttgtattatggttttagagagtgtaaattttaagttttggtagtttttatatgttgttgagtttgagagtgtagagaagttaagaattgaggtttgggaatttttgtttagattttagaagatgtatggaaattattggatgtttaggtagaagtttgttgtagaggcggagttttaatggagaatttttgttagggtagtgtagaagggaaacgtggggttggagattttatatagagtttttgttagggtattatataatggagttatgagaagagggttattattttttagattttataatggtatatatattgatagtttgtattatgtaattggaaaagttatagatatttaatgttagtttgtgaaggtagttaggagggaggttgttttttgtaaaattataggggtggagttgtttaagattatgggaatttattttttgtattaatatgatttggatgtgagagagagttaaaggagattattttgaagttttaagatttgattgttttattggattttggatttgtatggggtttgtagtttttttgttttggttaattttttttatttgagatggttgtatttttttagtgtttgtatttttattgtatataggaagtaattaatttgtttttgattttataggtttataggtggaagggatttgttttgttttggatgagattttgtattatggatttttgagttaatgattttgggggattgttgggaaggtatgatgggttttgaaatgtgaagatatgagatttgggaggggttaggggtagaatgatatggtttggttttgtgtttttatttaaattttattttgtagtttttataatttttatatgttgagggagggatttagtgggagaagaatgaattataggggtaggttttttttatgttgtttttataatagtaaatagattttataagatttgacggtttttaaaaaatgggagttgttttgtataagttttttttttgtttgttgttatttatgtaagatgtgatttgcgtttttttattttttgttgtgattgtgaggttattttagttatgtggaattgtaagtttaataaattttttgtttttggtaaaaggtttagttttaggtatgtttttattagtaggatgaagatggattaatatatgtttttttttagaaattaatttttgtagcgatattttttgttggttttttattagataacgtataaattgttgatttaaataatgattttattttataaatattttttaaatatttattttttatttttttggtttaagtttttattattttttgttaggattattattgttttaatttatttttttttttttagtttgaagttttaaaatttattttgtagtattttaagaagtatattgtaaaaaatagatgatagtatattttgtgattgtttgtttatattttgtttatataatgtttttttttattttaagtattagttattaaaatatttgtggaatgttggtgttttttagttttaggaaatggatgattatttatttaagttaattagggagattaagttttttttaagtagttgattaaaaatagatatgtgatttagttttagttattggtgtttaaatagaagtttgtagtaggaaaatatttaaaaaaaattttttttgttaggtaaaggatatgagttagaagaaatagtttgttatttgttttaattatttttgtgtttttatttggaatgagttgaggtaattgaattgagtgtagtggaagaaatgttttatggaagatattattgaattaatgaattaattagtattttttttttttttttaaataaaaaatttttttgtaaattttttattttttaaattatttaatttaagaatttatgttgtttgaggttgaaattattttaattagtttattgattatttaattttatttttttaaattttttagtattatatgtattgtttattggataaagtgattttttgtttggtatttaaggatttttataatttggtatatttttatttttttagttttattttttgttagtttttgttttttttttgtttgttttattatattaattgatagtttaatttttttatatttttaatatataatgttattttatatatattgttattttatgatttaatagatttaattatttttttttattttgaaattttttttatatattttttattttgttgtttatattttttttaaatgattatattaaagtttattttttttttggaaattatttatatttattataggttatttttgggtgtttttgtaatattttatacgtttttatgttttagtatttattgtattttattaaaattttttttttatttgtttgtgtattttttttgtattgaaatattagtgattagagttattattaattatttattttttttgtgttattaattttttgatataaattaagatgattaataaatgttggttgaattaaattaaatataatcgagtatgtagaaaatttatttaaattgaataattaaaatcgagtttttatttttatttttttttt

SEQ ID NO: 97 - DNA, 7906 bp, Artificial Sequence
  chemically treated genomic DNA (Homo sapiens)
agtaattataatttttaataagcgtattttaagagcggaagtatagggtgtattttataaattgtaaaggtcgatgcgtgtattttttgggatttttgagaaggtttttttttttttattttttaatttttttatttagttaggacgttttttttttcggatttttattgttatttttttttttattggtgtttttttttagatataggtttttgttttttgaattttagtttttttaaatataaaaagaagaaaattaaatttttttttttatggaggattatgaggatttaaatatatgaattaatatagagaatgaggttggtatcgagttttgtgggtttttaggagtgtttagttattattattattattattattattattattattattattattattattattaatagtttagaaaatagtgagtaaaagaagaaagaaaaattatttttgaaaatttttttttagtagtaattattattaataattggagaataatttttttggtttttaaataaaatgtatgaagtgaatttttaggaatttattatattgtgtaaattgtttggagatttatttttgttatataataatatatcgtgagtaatttgatatgttattatgttattttgtgtattattgttttagtggtttttaaattatttatagtattagtatattattgtttaatgtaatagtgattttatggattattgttaaagttggtttttaaattttttttttaagtaatttttattttttagggttttatttttggtttaggtttttttttttttagtttcgtttatagatttttattaaggtaaaatttagtattaaatatattatttattcgtttaaatattttttatggttttttagtgtttaatagttgaaattgtatttttattgtttggtagttaaagttttttataaattattgttttaattttgtttagtttttatattttttttgttatattttatatgttattttaaggatattttttatttttgttgtttttagtatttataaggaatttttttttttatttttgttttagttttatttattttttaaattttaatttaagtttatttttttttttttagttgatttattgtattatttaggattatatttaattggtaagaaataagatttagtattatagtgacgttaatataatacgagtttatttatttttgtatagaagatgattagaaatagaagatttaggggtaggtatggtagttttttagttattagggatcgagtttttttttggttttttttttttttatttttggggtgtatatttatttttgtggtttgatatggttgttagagttttagatattatatttatatttttgttagaaggtttttgaggaaaatgggagaagagtatattcgtttttttttagaaagttttttagaagtattatataagatttttatgtatattttattagttagaaagtgtttatttggttattttgttgtaagagaggttggggaacgtagtaacgtgtttattattaagaaagaagggagcgtggatacgggagatattttagttttttataatgagatagaaaagtttttttttttaagtataatgttgagtttttattttaggtagtagtagtgtgtgttggaagatataggttttggagttagatagatttggggtagattttggtttagttattgaattttagttagatgatttagaaaagttgtttagattttttgaatttttgtatttaaaaaatagaaaaggcggggtggggggagtagttgtgagaaggtaatcgattagaatttgtgtatagagaatataggagggtgtttagtataagtttgatggttatgaattgttatttttattagtattgtgttatttatatttatgtattttatattttataatattgtgttatttaaatttttttattataataatatttttattttattttattttaaagataagattttgttttgttatttaggttgaattgtagtggtgtgattatggtttagtgtagttttaaatttttgggtttaagtgatttttaagatttagttttttgagtagttgagggaagtttaggtatttggtatgtagttagggttgttagtaatatttgttgtattaaatggaattatattgttttgattttttttttgggtttggttttattttgttttcgttattgggatattgtgtataatgtggttttagtaggtttgggatggggtttggaaatttatattttttatttttttagtattgtaaattttttttttagaaggttttttaggagtattatataagatttttgtgtaggtcgggtatagtggtttatgtttataattttagtattttgggaggttaaggtagggggattatttggggttgggagttcgagattagtttggttaatatggtgaaattttgtttttattaaaaatataaaattagttaggtatgttggggtatgtttgtagttttagttatttgggaggttgaggtatgagaatcgtttgaattcgggaggtggaggttatagtgagttgagatcgtgttattgtattttagtttattaagaataaataaataaataaataaaaaaatttttgtttattattgtagttttaattttttgggtttaagtaatttttttattttagttttttaaatagttggaattataggtacgtattattatgtttagttaatttttttttttttttgtagagatagagttcgtcgttttggaatcgtttgaatttgggaggcggaggttggagtgaattgagatcgcgttattgtattttagtttgggcgataagagtaaaatttcgttttaaagaagaggaagaggaagaagaaggaggaggaggaggaggagatgaggaggagaggaggaagaggaggatgaggaggaggagaaaagaggaagaaaaagaggaagaagaagaagaagaggaagaagaggaagatgttgttgttcgttgttttggttgggttattagtaaggtatttgttttatagttttgtttagttttagcgagttgagttttaaaattgggttttaaggttttttatttttgtattttttcgggtaaattttcggaggtttcggtgtatcgcgcgtttagtcggtttaattcgagttagaagttttaattattgtttagtgtttgagttgtagttttgggttttttagaaatttggagatgtgcgtaaaatttagatgtcggtattttcgaatttttttaggttttagtatatttcggcggtttgtggatagatgggaggttattaatcgtttcggcgttcgtagttcgatttttgtcgttagatttcggacgtttttcggataataaagttttcgttttaatttattttttttaatttggacgtttttaatttatagtttttattgcgtttagttaaaagtcgagggaattcgttgttttttcgcgttcggataattatttttaaatggttacggtagttttttgtgttttttggagattagaatttcgtagttattaatggtagggtcgagtgagtcgttaattattttcgtttattttttgagagtcgttggtttgggtcgcgggaggagaggttataaagcgataggcgtagaaaatggttaagtttcgatttcgttttaggtagattttgtattttttttgattttaatttattttttttgtttttattattattattattattaatagtaaatattaaattacgtttttttcgaaattggtaaaagaagagtttttaagttttatattagagtttatttttaggaatttttttttttttttagtttttttttttaaatgtgttttttttttttaggattagcggtttagagatagggatatgttattgttttcgaggacgcgttgtttgaggttattttaaggttagatcggtgttttattgacgattttgttggttttattttagtaagttttatattaaaaggatttggtagttttttttttcgttcgggcgttataggtgttgtgatttttgggatagaagtttagagcgagggtgggggggggggaatatatatcgtgtatgaaaatcgattgtagattttagataattttacgtatttttatatttttggtattataggaagtagttttttttcgtaaggtttattttagttttaagttagagataaaggtttatttttatttcgaggtaaagtttataagattttagaataggaagaaaatgaaggtttggttttgtttcgttttttgaaaagaagttaatagtatgttttttttttaggataaatagttatgcgtattttaaaaattatatataaaaggaatgtgtaagaaataattttaatttaaattattgtggtagaagaagagggggggttagatagtggaggggggtatagggaaatttagttatagattaaagagaaaggtaaaagaagtagtagaggagagaaataaggacggggaaaaaaagaggagcggaaaagagggttgaggaggggaggggaggagggtagaagagaaggaacgagaataagggaaaattttttcgggaatatagaaagatagagatttaggggattttcgtagagagggttttttgggttttagcgtagaggaaagtttttcgggtattttttttttttttttgtttttcgtcgtttgggttttgttttgcgtgtttttaggtttagcgcgttttcgggcgagtttttaggagcgcggtttaatggatcgtttcgggttcgttttttcgcgcgttgattggtcgtcgtttcgttggtttcgttttattagtaagttttttggggagtcgcggtagggttcggagtcggcgagtgttttcgggaattttgtttgcgcggcggtagcgatcggaggttaggtttagtacgtcggagttggtttgttggggaggggcgggaggcgcgcgcgggagggttcgttcggttagggtttcgggcgttcgtagaggtcggtcgcgtttttagttcgttcggagtttatgttcggcggttggttagtgttgcggtagaagggggggttcggttttgtatggtttcggttgttgatatgatttttttgttattcggtgttaaagtggaggatttcgttttcggtaagtcggcggggggaggcgcgggttaggtttttagcgtcgtcgcggttacggtagtcgttatgggcgcggacgaggagggggttaagtttaaagtgtttttttcgtttttgttttttagcgtggaggcgtttatggtcgattataggaagtcgggggttaaggagagcgttttggcgtttttcgagggcgtgtaggcggcgggtggttcggcgtagttattgggcgtttcgtcggggtcgttgggagtttcggacgcgtttttttcgtcgcggtcgttcggttatttttcggtggggggattttttaagttgttagaagatgcgttcgttaaagtcgagagtttcgagaagttcgagaggatttcgtggatgtagagttttcgttttttttcgtcgtcggttagtgagtagttagaatttaggcgtagagggagggggtcgggtggggtgtgggattcgagggtttttggtggttttcggcgtttgcgtatttgtagtcggtgttagggagtcgtgggttgtaaggtcgggttttgcgtttttttttatttttatttaggaagaaggttttagattttttcgttttggtttagagacgttgcgggtgggagttaacggataggtcgtcgatgtttgggtattttgtttttttgtttttattaaacgattttaggggtttatgattttttatttgattttaaattttgttttatcggttttattttagcggatgaatgtgtgtggtgcggtattttttttgtattcggagttttattttttcgtagtaggagttggtgttttttagtttttttttttttttaagtatttttttgtttagaggtttcgaagtttttatagaattttatttttttatgttttttgagtttgaggtagatagttggtgttttgggcggatggatgatttaggggtggggatatttaggttttagtggagggggcggggtattaagttaattagggtaaggcgttttcgttaattttatgggaagtttttaaacgtttaggattgagttattaaagtggattttaggtgtttaaggcggttcgttttaaggttttacggttttttggttgttttatttagagaatacgttcggagatattttaggagtacgggaaatttttaagtttttttcgtttttttcgattattttgttcggtataatagtagttagattttaatggcgtgatgttgaggaatgatttttatttggggattaaacgtttttgaaaggttagtttttttttaagtttaatggtcggagaaggtggtttcgttttgggttgtcgtcgttgaagggagtgacgtttttttcggcgttcgtttttcgggcggttcggcggaaagttagttgggggttaagcgtttttcggattttcggtggtttttagtagggaagaagcggggtgttaatacgagatttcgtttgatttatattttggtggtttgaaagtttaaaggatcgttgtgttttttttgttttgttttgttttttttgtttgtttgtggttgttttttagagaggtgtgaaaaaatgtatatttaggtaaaattcgcgtggtgaaatatcgtcgatttgaatttattttttgtcgggaaagttgttgtataggtaaagtgttttttttaacgtttagggttttgggttttaagatttcgaagttaaagcgatttcggttgtgttgggataatttgttttatattttattcgggggtagtttttagtagattttattttcgatttgtattagttttgcgttttgatgtttttttattgtttatttttgaggtttattttgaagttaaaagaaaaagatagttgggtatgttgatgtttgttgattatgttataggttgaggggagaggcgattttaatatttttttcgtaataatattaatatatatatatatatataaacgtttgagtggggttagagggttttggcgttaggggtgaacgcgatttaatagaggattgagataatttaaagaaaaagtttattagaataaagtagtttttcgtttttcgttttagatgatattttttgtttttaagagggttggttatagtgtattttttatgatggtttgcgttgttttatttttggtttgcgggaattatttttagaatttcgtaggagcgaagtgtttcggggaaagtgtagaatttgatttggattttatgttataaaattgtttagttttatattgaagtatttcgtgggtattgataaatgtttggttaacgcgtaaaattaaatgtgtttttgggttgggcgtagggtttttttttgtatgttcgttaattgtattaatatttattttttttttggatggttttgggaggaggttcgttatgaaggtttttttaagtcgtcgggtagtataaaggtgattttatatttttttagttgtttaggtttaagatgtggatatcgagtttttaacgtgggtattttttttttggaattttagtttttttatttgtaaaaagtagataggaattttttttttgcggggttgtaatgggaattggagaaaatatattttaagtgttttgcgcgatgtacggtatcgaggtatttggcggtatttaatatttggtattgtttggttattattattattttttgggttgattatgtttcgatgttttttttttaattttttgtttttttttttttcggtttttagg

SEQ ID NO: 98 - DNA, 7906 bp, Artificial Sequence
  chemically treated genomic DNA (Homo sapiens)
tttgagggtcgaaagaaaaaaaagtaaggggttaagagagaagtatcggagtatgattagtttaagaagtagtaataatagttaaataatattagatattgagtgtcgttaagtgtttcggtgtcgtgtatcgcgtaaggtatttgaaatatattttttttaatttttattgtaatttcgtaggggagaagtttttgtttattttttgtaaatgaagaaattaagattttaggagaaaaatatttacgttgaaggttcgatgtttatattttaggtttaaatagttgggaagatgtgaaattatttttgtgttgttcggcggtttaggaaggtttttatggcgggtttttttttagggttatttagaggaaaggtggatgttaatatagttgacgaatatgtagaaagaggttttgcgtttagtttaagggtatatttagttttacgcgttggttaaatatttattagtgtttacggagtgttttagtgtggggttaggtagttttgtggtatagaatttaaattaaattttatatttttttcggaatatttcgtttttacgggattttaggagtagttttcgtagattagagatggagtagcgtagattattatggagggtgtattgtggttagtttttttagaaatagaaagtgttatttggagcggagaacgaggggttgttttattttaatgggttttttttttagattgttttagttttttgttggatcgcgtttatttttggcgttagggttttttggttttatttaaacgtttgtgtgtgtgtgtgtgtgttgatgttgttgcggggggagtgttgagatcgtttttttttttaatttgtggtatagttagtagatattaatatgtttagttgttttttttttttggttttaaaataaattttaagggtggatagtgaagaagtattagagcgtaggattagtgtaggtcggggatggggtttgttggggattgttttcggataaaatgtggaataaattattttaatatagtcgggatcgttttgatttcggggttttggggtttaaggttttaagcgttggaaaggatattttgtttatgtagtagttttttcggtagaaagtgaatttaaatcgacgatgttttattacgcgggttttgtttaagtatgtatttttttatatttttttaaaaaataattataaataaatagaaaaaataaaataaaataaagaaaatataacgattttttggatttttagattattaggatgtgagttaaacgaaatttcgtgttaatatttcgttttttttttgttggaggttatcgggagttcgggaagcgtttggtttttaattagtttttcgtcgggtcgttcgaggggcgggcgtcgagagaaacgttattttttttagcggcgataatttagagcggggttatttttttcggttattaggtttagggagggattggttttttaaagacgtttaatttttagataaaaattattttttagtattacgttattgaaatttggttgttattatgtcgagtaaaataatcggaggaaacgaggaaaatttgggaatttttcgtgtttttgaaatattttcgagcgtgttttttgagtagagtagttagggggtcgtgaggttttggagcgaatcgttttgggtatttggagtttattttaatggtttagttttagacgtttgggagttttttataggattagcgggggcgttttgttttaattgatttggtgtttcgttttttttattggaatttgaatgtttttatttttgaattatttattcgtttaaagtattaattatttgttttaaatttaaagggtatggggaggtagaattttgtaggagtttcggaatttttaggtaaagaggtatttgaaagggaagaggggttgggggatattagtttttattgcgagaaagtgaaatttcgggtgtagggaagatatcgtattatatatatttattcgttggggtgaagtcgatgaaatagagtttgggattagatgagggattatggatttttgaggtcgtttggtgggggtaggaggatagggtgtttagatatcggcgatttattcgttaatttttattcgtagcgtttttgggttaaggcgaggaggtttggaattttttttttgggtgggagtggagggaggcgtaagattcggttttgtagtttacggttttttagtatcggttgtaggtacgtaggcgtcggaggttattaggagttttcgggttttatattttattcggttttttttttttgcgtttgggttttggttatttattggtcggcggcggggagaagcgggggttttgtatttacggggttttttcgggtttttcggggttttcggttttgacgagcgtattttttggtagtttgaggagtttttttatcgagaaatggtcgagcggtcgcggcgaagagggcgcgttcggggtttttagcgatttcggcgggacgtttagtggttgcgtcgagttattcgtcgtttgtacgttttcggagggcgttagggcgttttttttggttttcggttttttgtggtcggttatgagcgtttttacgttgaagggtaggagcgaaggggatattttgggtttggtttttttttcgttcgcgtttatggcggttgtcgtggtcgcggcggcgttgggggtttggttcgcgttttttttcgtcggtttgtcgaaggcggagttttttattttgatatcgagtggtaaagaagttatgttagtagtcggggttatgtagagtcgggtttttttttttgtcgtagtattggttagtcgtcgggtatgggtttcgggcgggttgggagcgcggtcggtttttgcgagcgttcggggttttggtcgggcggattttttcgcgcgcgtttttcgtttttttttagtaggttagtttcggcgtgttgggtttggttttcggtcgttgtcgtcgcgtaggtagagttttcgggagtattcgtcggtttcgggttttatcgcggttttttagagaatttgttaataaggcgaggttagcggggcggcggttaattagcgcgcgagggggcgggttcggagcgatttattgggtcgcgtttttggggattcgttcggaggcgcgttgggtttgggggtacgtagggtagggtttaggcggcggagggtaggggaggagagggggtgttcgggaaatttttttttgcgttgaagtttaagaggttttttttgcgggagttttttgggtttttatttttttgtgttttcggggggatttttttttgttttcgtttttttttttttgtttttttttttttttttttttagttttttttttcgttttttttttttttttcgtttttgttttttttttttattgttttttttatttttttttttagtttgtggttgggtttttttgtgtttttttttattgtttgattttttttttttttttattataataatttgagttgaggttattttttatatattttttttatatatagtttttaaaatacgtatggttatttattttaggagaaagatatattattaatttttttttaagaaacgaaataaaattaaatttttattttttttttgttttgaaattttgtaaattttatttcgaggtaaaagtgggtttttgtttttaatttagagttggagtaaattttgcgggaagaagttattttttgtagtgttaaggatgtgagaatacgtaagattatttagaatttgtagtcggtttttatatacgatgtgtatttttttttttttattttcgttttgaatttttgttttaagggttataatatttatagcgttcgggcggggaaaggagttgttagatttttttgatatagaatttattgaaataaaattaatagaatcgttaatgaaatatcgatttggttttaaggtgattttaaataacgcgttttcggaaataatgatatgtttttatttttgggtcgttgattttggaggggagaggtatatttgggggagggggttgggaaaagaggaaagtttttggaggtggattttagtgtgggatttgagaattttttttttgttaatttcggagaaaacgtgatttaatgtttgttgttaataataataataataataaagatagaaaaaatgagttggggttaggggagatgtaagatttgtttgaagcggggtcggggtttggttattttttgcgtttgtcgttttatggttttttttttcgcggtttaggttagcggtttttagggagtgagcggaggtgattggcggtttattcggttttgttattgatgattgcggggttttaatttttaggaaatataaggggttgtcgtggttatttaggggtaattattcgagcgcggagggatagcgaattttttcgatttttaattgggcgtaataaaagttgtagattaggggcgtttagattagggaaaatgaattagagcgggaattttattattcggaagacgttcggggtttggcggtaggggtcgggttgcggacgtcggagcgattggtagttttttatttgtttataggtcgtcgagatatgttgaggtttggggaagttcgggaatatcggtatttgaattttacgtatatttttaggtttttaaaggatttaagattgtaatttaggtattgggtagtggttggggtttttagttcgagttgggtcggttggacgcgcggtgtatcggggttttcggaggtttgttcgagagggtataaggatagaagattttaagatttaattttgaagtttagttcgttgaggttgagtaaggttgtagggtaaatattttgttggtagtttagttaggatagcgaataatagtatttttttttttttttttttttttttttttttttttttttttttttttttttttttttttttttatttttttttttttttttttttttttattttttttttttttttttttttttttttttttttttttttttttgagacggagttttgtttttgtcgtttaggttggagtgtaatggcgcgattttagtttattttaattttcgttttttaggtttaagcgattttaggacggcgaattttgtttttataaaaaaaaaaaaaaattagttggatatggtggtgcgtgtttgtagttttagttatttgagaggttgaagtaggaggattgtttgagtttaggaggttgaggttatagtgatagatagaagtttttttgtttgtttgtttgtttgtttttggtaggttggaatgtaatggtacgattttagtttattgtagtttttatttttcgggtttaagcgatttttatgttttagttttttaagtagttgggattataggtatgttttaatatgtttggttaattttgtatttttagtaaagatagggttttattatgttggttaggttagtttcgaatttttaattttaagtgatttttttgttttggttttttaaagtgttgggattataggtatgagttattgtgttcggtttatatagaagttttgtgtagtatttttgggaagttttttgaaagagagatttataatattggagagatgaaaaatgtaggtttttaggttttattttaaatttgttgagattatattatgtatagtattttaatggcgaaggtagggtaagattaagtttaggagaagggttaggataatgtgattttatttaatgtagtaaatattattgatagttttgattatatgttaggtgtttggattttttttagttatttaggaggttaagttttgaggattatttgagtttagaagtttgaggttgtattgaattatgattatattattgtaatttagtttgggtgatagagtaagattttgtttttaaaataaaataaaataaaaatattattataatgaaagaatttaaataatatagtgttgtagaatatagaatatatggatatagatgatataatgttgatggggatgatagtttatgattattaggtttgtattgggtatttttttgtgttttttatatatagattttagtcgattatttttttataattgttttttttatttcgttttttttattttttagatgtagagatttagagagtttaagtaatttttttaaattatttagttggaatttagtaattgagttaggatttattttaggtttgtttgattttaaagtttgtgttttttagtatatattgttgttgtttggggtaagagtttaatattatgtttggaaaaaggagtttttttattttattgtggagggttgggatgtttttcgtgtttacgttttttttttttttagtaatgggtacgttattgcgttttttagttttttttgtagtaaggtgattaagtgaatattttttggttaatgagatgtatatagaagttttgtgtaatatttttgggaagttttttgaaagagagcgaatatattttttttttattttttttaaaaattttttagtaggaatgtggatatgatgtttggagttttagtaattatattagattataaggatgaatgtatattttaggaatggaagagaggaaagttagaaaaagattcggtttttgatggttgaagagttattatatttgtttttagattttttatttttgattattttttatgtaagggtgagtgaattcgtattgtgttaacgttattgtgatattgggttttgttttttgttagttgaatgtgattttaagtggtataatgggttaattgagaggaagagaatgaatttgggttgggatttgaaagatgggtaggattgagataggaatgggggaagaagttttttataggtgttgggaatagtaagagtgagaagtgtttttgaggtggtatgtggagtataataaggaagatgtaggagttaagtagggttagagtagtggtttgtaaagagttttggttgttaggtagtgaagatataattttaattgttaagtattggggagttatagaaggtgtttgagcggataagtgatgtgtttggtattggattttgttttgatggagatttgtaggcggaattgaagaggaggaagtttgggttagaaatggggttttggggggtgggaattgtttggaaaggaggtttggagattagttttggtaatggtttatggaattattattgtattaaatagtggtgtgttaatattgtgggtgatttggaagttattgaaataatgatgtataagatagtatgataatatgttaagttgtttacggtatattgttatatgataaaaataggtttttaaatagtttgtataatatgatgagtttttgaaaatttattttatgtattttatttaaaagttaagaaggttattttttaattgttaataatagttattgttagggggaagtttttagggatgatttttttttttttttttgtttattattttttaagttgttagtagtagtagtagtagtaataataataataataataataataataataatagttaagtatttttgagggtttataaagttcggtgttagttttattttttgtgttaatttatgtatttaaatttttatagttttttatgagggagggagtttaatttttttttttttatatttgaggaaattgagatttagaaagtaggagtttatgtttaggggagagtattagtggaaagagaggtgataatgaggattcgagagaggggacgttttagttggatggaggagttagggagtgaggagggaaaggtttttttagaaattttaggggatgtacgtatcggtttttatagtttataaagtatattttgtattttcgtttttaaaatgcgtttgttaggaattatgattgtt

SEQ ID NO: 99 - DNA, 17419 bp, Artificial Sequence
  chemically treated genomic DNA (Homo sapiens)
tataggggttggttattacgtttagttaatttttgtatttttagtagagatggggtttcgttatgttagttaggttggttttgaatttttgattttagttgatttattagtttcggttttttaaagtgttgggattataggcgtgaattattgtatttagtttatatatttttttttatatgtaaatattattttaagataaatttttaaattgggagaggtggtttacgtttgtaattttaacgttttggaaggttaaggtgggaggatggtttgaggttaggagttggagattagtttgggtaatatagtaagattatttttataggaaaattttttaattaattaggggtggtggtatgtgtttatagttttaattatttagaaggattattttagtttaggagtttagggttgtagtgagttgattgtgttattgtattttagtttgggtgatagagtaaaattttgtttaaaaaaaaaaaattttggaagtggaattataatgttaaagaaaatataaatttaaaattttcgggttaggtatggtggtttatatttgtattaattttagtattttgggaggttaaggaaggtagattacgaggttaagattgagattattttggttaatatggtgaaatttcgtttttattaaaaatataaaaattagttgggtgtggtggcgtttatttgtagttttagttatttgggaggttgaggtagaagaattgtttgaatttgggaggcggaggttttagtgagtcgagattatgttattgtattttagtttggtgatagagcgatttaaaaaaaaaaatattttttttttcgtagatattattatattaaattatttttgaaaaaggttgtaaaaacggggtttttgtaaaaagtaaatattttttttagtaattgtttttataagtatttaaataaaaatattttttttttttatttgttgtgaaaggttgatttttattttttatttgattaatttgtaatatttgatagaattaattatttttttttttatgaaatatattttttatttgttttgtttttttttttgtttgtttatttgtttgtttttgagatagagttttattttgttgttaggttggagtgtagtggtttatttcggtttattgtaaattttgttttttgagtttaagtagtttttttgttttagtttttttattatttgggattaaaagtgggagcgagtatatttggataatttttttatttttatagagacggaggtttcgttatgtttgttaggttggtttagaaattttgattttaagtgatttatttattttggttttttaaagtgttgggattataggtatgagatattatgttaggtttttttatttgtattttaaggtgggatgtttttggggttttttttagaatatattggatttttttttttttttaagagatagggttttgttttgttgtttaggttggagtgtagtgtgatgattatagtttattgaagtttttaatttttaggtttataggatttttttattttagttttttgagtaattgggattataggtatatgttattacgtttagttaattttttaaatttttatttatttatttattttgagatggagtttcgttttgttttttaggttggagtgtagtggcgtgatttcggtttattgtaatttttgttttttaggtttaagggatttttttgtttcggtttttcgagtagttgggattataggtgttagttattacgtttagttaatttttgtatttttagtagagacggggttttattgtgttggttaagttggttttaaatttttgattttagttgatttatttatttcggtttttaaaatgttcggattataggtaaattttttaatttttatttttgtagagatagggttttgttatgttgttaaggttgttttataaatttttggatttaagtgatttttttgtatttggttttttaaagtgttgggattagtaaaggtgtagttatagtttttagttggatttttttttttaatttttttttttggttttttttgtttttttgtattttgaatattgaaaggttttaggtgttagtttttggttttttttttatttataatatttttggttggattttatttaattttatggatttaaatattttttttttatttggatgtttaagagaaatttaaaaatgtttaaagtcgaatttataattttaattttaaaatttagttttatattttattttattttaatttagcgaatggtaattttatttttttagttgtttagagtaaatttttgtttttttttttttatattttaagtttttttttttattaaggtttttgttgaagttagatgtttaaagaaattttttattatatttttgagataaaatttttttattttttagtattattgtttatttttttagtttgtttatttttaaaatatagtatgttataatttttaaaattagtttatgtatttttttaatttgatcgttgttttttttattagaatatgagttgagagtagaaattttgttggtttattagggtatttttagtatttatagtagtgttgttggtatagtggttatttaataattatttgttttatgaatgaacgatttatgtaatttatatatagataattgttaaaaattaggttgttgagatggtaaaggtagtagatttagagaagaaatattaggtttggggtttatattagttatagttatgtagttttgggtattattttttaaagtttatttttttgtaaaacgggatttttgttattttttttaataaataagaaagttggaatagttaatatttatttgatagtataagataaaagatttattatttgtaatttattagaaatattttttttaattttttttttaattttatttgtttaggtataatataatatgagataatgtgttttagggttattattataatgatattatattattaagtttgtgtttttaatatattatttgtgtaaattttaagaatagtaattttaaggttacgtacggtggtttatgtttattattttagtattttgggaggttaagggagattaattttttgagatttagattagtttggttaatatagtgaaattttaattttattaaaaatagaaaaattagtcggcgtggtggtatgtatttgtggtttaagttattcggggggttgaggtgggaggattatttgaattcgggaggtagaggttataaagagcggagattatgttattgtattttattttgagcgatatagcgagatttcgttttaaaaataaaaaaatatatattagaaataattattagaaatagaaaattataagagattatttaatttcgtatatggggttattataaataattttagaatttagaaataagaaaaaaatattaaaagttttaaaattaataaaaaattagttttaggttaggtgcggtggtttacgtttgtaattttagtattttgggaggtcgaggcgggtggattacgaggttaggagtttaagattagtttagttaagatggtgaaatttcgtttttattaaaaatataaaaattagtcgggcgtggtggcgggttaattaggtggtgtttgtaattttagttattcgggaggttgaggtagagaattgtttgaattcgggaagcggaggttgtagtgagttaaaatcgtgttattgtattttagtttgggcgatagaatgagatttcgttttaaataaataaataaaaaaagttttagatgagttttgttagtagtaaacggtttgtaaaagaaattcggtatttggttaagttttaagtgatttgaattacgtatttttaggattttattgggatgattgtaatttgaacgcggtttttagagtagagtaagtatattttttggatttagtaatataaggggttagttttttttagtattttagttgttatcgttttgttaggttttttaggtaattgtttattttattttttttttagcgtggacgtttaaggggagggagtattttttttcgagggttaattggtatgtagtttacgaagatcgcgtgagttttttaattttagatttgttgcggggcggggacgtgggggtgataaaatttagattacgattttttatgagttttggtaatttcggggtgattttaatatcgatgaggttacgcgcgttttagttttgatattttttttagatcggcggggtttgaaatagcgggttaagttttatttacggttgagcgttagatttagttgaggagattttaaaagcgttatgttgggtttagatttaggttttttagagtagaacgcggaggggttcgattttagtttggtggcgtaggtgtgtgataaagtatgagggcgcgttaagttttttagttttatatttgttgtcgagtttagcgtttgttacgttttcgtgcggggattcgtttaaaattttttggaagttaggcgatttagatttcgttatcgcgtttttagagattgggcggaaatcggagattcgtttttcgaattcgcgaaattatttttcgcgagattgtttcgttttaatttcgtttcgtaattttattttttgattggttggaattacggtcggatttcggagttttttttagtttttttttcggtcgggtttttcgtcgaatataaaggcgtattgtgaattggtttttttttttcgttaattattttcgttagttatttattatcgattttttttatttttttttttttttttcgtttcgtagttttcgatttgttagttttcggttagttaagggattcgggttttttcgaattgcgtatgcgttatcgcgtttgtagggggagaagcgggtaggggcgtaggcgtagtagtgtgattttttggttagtttttaagtacgtgggttgggttgttttgtttggttgcggagggagtggaatttcgatattggtggtgtttatcgtgggtagcggattaataaaggttatggcgttagtagaaattttgaacgggaaggagattttcgcgtaagtatttgatattgttgttgagtgtggggttgtggacgagggttttgagggtgtgtaggtttttcggatttattttttgcgggagggatatttgtagcggaagagttaggtttataatatttgaagatttgtagttaaagaaagagaattcgggtataatttgcgtttgtaagtggattgtttagtggttgtagtcgttggtttttgtgtttcggggaaaagttttgtgtcgattatgtttttaaacgcgtagttgttggtgattttttgtcgggagagtgggtagttgcggttttttggagtttttttagttagaatttagaaatttaatttatttaattttcgttaatttggaggtgagtagatggagattagtgaggtgataaggtttgataagattataaggttgataatgatagagggtttttttagtttatagttttttttattatattatagttttattatacgttaagtgaaatttaatatattttttttttttttttaatttcgtgtttttttttaatagttatttttttgttttggttttagagttatttgaaacgtaatttggtttttgagttttgagaatattttgtattttatttgatttttgtttgttttatttttgcgggatatttgaatgtttaattagtgggtatcgttgttagttttatttttaggaagtaatattggttgttttttgtttgggaggtgattggtgaggaaaaatgagagtagaaggaagagggaaaaatatattttttttagtagatgaaggagggaaagatatattttgtgtgattttattgagtttgtttttgggattttttatattattcgttatgtaagttattgttgttagttatagtagttattaaattgtaattgttttgtaatttttaattttgtaataggtttttgagtgaattataaagttatcggtggtgaaaagttcgggtttagtggtttatgtttgtaattttagtattttgggaggtcgaggtgggtggattatttgaggtttggagtttaagattagtttatttaaaatggtgaaattttatttttattaaaaatataaaaaattagtcgagtgtggtggtaggtatttgtaattttagttatttgggaggttgaggtaggagaattatttgaatttggggggtagaggttgtagtgagttgagatgcgttattgtattttagtttgggtaataagagcgaaatttcgtttaagaaaaaaaaaaaaagaaattataatatttattgtttagtgttttttaatatgtggtttgttaaattgtatttttgttttattttttgtttttgtttgtttgtatttaaatttatttttttttttagtggttttttgttttaatataaaaattttttttttagaaagattgattgtgaagagataatttagtgtataataatagtgtagataatttagtataataataatgtatttgggttagtattgagaataggtgtttattgaatatattttcgttaattggagagtaaattaaatatgtttattaattttataagggtaaatatatgtattgttttatttttgtttatattttaaatatttggaaattttgttttttgttttattatttgtgtggttttaagtaaattaattaatttttttgtgttaaagtttttttaaatgttaagtaaaagtaatgtttaggttattgggatgttagtagaattaaatgggtttttaatagatgattatttataattttttttggtatataataagtattcgatatatgttgtattaataattagtaattagttaatgtatatatgaatgatttattatttttttttttttttatatggtagttgttgttttgagatttatttttttttttgagatgaagttttgttgtgtttaattttggtttattgtaatttttgttttttgtatataagtaatttttttatattagttttttgagtatttgggattataggtgttcgttattacgtttagttaatttttttttttgagatggagttttattcgtcgtttagattggagtataatggcgtgatttcggtttattgtaatttttgttttttgggtttaagcgatttttttgttttagttttttaagtagttgggattataggcgttcgttattatgtttagttagtttgtttgtttgtttgagatagagttttatttttgttgtttaggttggagtgtaatggtatgattttggtttattgtaatttttattttttaggtttaagcgatttttttgttttagtttttcgagtagttgagattataggtgtgtgttatttcgttcggttaatttttgtatttttagtagagacgggtttttattatgttggttaggttggtttgtaatttttgattttatgtgatttatttatttcggttttttaaagtgttgggattataggtatgagttattgtatcggttttagaattttttaaaaatttagtttattttttatattttattttgcggattaggaaattatttgaggttagaaaagtgatgtgatttgtttaagggtgaatggtaatggtttaattaaaattaaggtttttatttagtatatgatgttttttattttaattagtatttattatttgttaaaaggaatttcgtaagttttttttttttttttttttttttttttttttttattttttagataaggttttgttttgttgtttaggttggagtgtaatggtacgatgttgttttattgtaatttttattttttgggtttaaacgatttttttgttttagttttttaggtagttgggattacgggtatgtattattatgttcggttaatttttgaatttttagtagagatggggtttcgttatgttggttaagttggttttgaatttttgattttaagtgatttgtttatttttattttttaaagtgttaggattataggtgtgagttattgcgttttcgttggcgttttgttttttttttatagttttttttttattagtatgttttttattttgttgagaatgttatttttgattcgtttttttttattattattttttttttatgtttttttgggagttcggatattaataaagtttagtattttagattttttttttatttgttttattttgtgggaaattgggtatttatatgatggatttagttgttaaattatttttttttggaagtaatagtttttttttttttttacggggaattttaagtttgtagtttgaatttgataatcgggggaaggtttgagagttagagataagtatttgttttttgtgggtatttatttatttatttaataagtagttgtatgtgttttttaagttaggtaatttttaaagttttgagagtttaatagtgaataaaatagtttaaatttttatttttatgaaatttgtatattgatgggtagagatagatatttaaataggtgaaatatattgtgagttggtgggaagtataaagagaatattagagtagaaaagagggataggagtttttgtggtatggtggttgtaattttaaatatgggagttatagtttttgtaaaagtgatttacgggtaaagatttgaaggaggtggagttttaagtttgttaatgttgtgagggaaatagtttttgattaaaaatatagtttgtgttatagatttttgtttttattagttattaatttattgttttggggggttaatggtaatggttttgtgagaagttgatcgagtggaggtttttgagtagaggaatttgattttgttttgggtagaagggtggtgttttttaaaagattatgtaaagtgggagaaggatgtgtattagtgttggaagatttattttgttttgtaggtaagaaagtatagttgttttataagtgggttttttaaaggggggtttattatatttatatgatttgtttggttttttttttttttagtttgttataattaagtttgttttttttattggtggtattttttttgattaagttttttttttaaagagattggttgtgaagaggtagatggtttgagtaggtgttgcgagtgtttgttggttaagtgtagggtaagttgggtatatttgtaagttcgttgtggatggtagttttagagtttaagtacggtgttgttttttttgtgtattattgggttatgtaatttatttttgtgttttagtttttgtatattggggtagtaatgttatttaatttataaggttgttagaattaaatgagtttaatatttataaagtatttagagaagttgttggtatatggtaagttttaataaataggtatttagaaagtatttattgaataaaaaagtgatgtttgtgtttatttaggttgtatttttgggagttggtttataattttgagatttaaaattagaatttattttagtgattaaagataaaagtttggaattttggttgtatatttagttatagggttagaagaattgtttttgtgaaaataatttgtttattatagtgaagggtaggtttttttggttattaagttaatatggataagatttttattttgttttgtagattaaatatatgtaggtttttttgtgtttaaaaagatttgtttgggtagggcgtggtggtttatgtttgtaattttaggattttgggaggtttaggtaggaggattatttgagattaggagttggagattagtttgattaatatggtgaaattttatttttattaaaaatataaaattagttgggtatggtggtttatgtttgtaattttagttattttagaggttgagataggagaatggtttgaatttgggaggaggaggttgtagtgagttagtgagttaagatggcgttattgtattttagtttgggtaataagagtaaaattttattttagaaagaaaaaaaaaaaaaatttgtttgtaatgaattttaaagtgtaggttgtttaaaagttatatggaaatttgattgttatagttggattgattttggaagtttgtgtaggagaggtcggagttttagagaggttgggatttttagttaggattttagttaggttgttgggtaggttgtagcgatagtgtagtagagtttagagttggtagttaattattatggttatggtatttgattggggatgtggtttgtaaataagtgtttgtttttgtttattaggggagttgggattaggtagtttgggatttgggtagtggggttttgagtagaggtttgtggttttttgttatattttttatttgtatgaagaattttttagaaggaaagttggtttagtatagaggagggtttttggagtggaagtaaatggttttttttttttttaattgatttagtagaggttggtagaatagaggttaaggggtagggatgtttgtgtggttttggaaaagttagttttatttttttttttgtgtagtagggatgatgagaattgtttattttttgacgttgttttaaggattaaaagaatgtaagatttttaaaataagtttttttgacgttttatttatagtgtagaaggtttttattatttttgtattgtgcggttggtttttttttgtattttttaattgattaaaaagtagtttttgttattttgtaaatttttgattttgaagaagtgggtggttaaaggtgttatagttaagattttttagttattcggttattatttttatttttaattttgtagtttatgatattttagttagaagttaagtgatttgtttaggtgttttaaggtaggtggtagaggttcgatggtgtatttttttttttattatgggtttgttattggtttgttagaaggaattgtaaatttttattttttagtaggagatattttgggtttggttttttttgaggtttttttattgtgaggaaattattttatttattagtttggttgggaagtatttaaatagattttttttaaaaagttatttttgaagttatagtttaattttgattggttagagataggttagatttatttattttgttggttaagttttttttttttttttgttttttattataagtttggacgggagacgtattgtttggtatttggtgtttgagaggttttaggagataagggagtatttttgtgaaaggttttgttagagtttgttaggaatttaattttgattgtaatgaatgatttaatattataagtgatttttgggtttaggtgtttaaatattagtttttttttagtaagtagttttttagatttaattttttttatttaaggttttgtttagtttttttgaaaagtaggaaggttaggtttttgtgaggttttttttattataagtttttggtaggtttttttttttaagtggagaatttttattttttttattttttttatttttttttttgatgatttagagggttgtaagggatttagagttgtttattggagttttagttagttttagcggttagatttatggttaggtaattttttaatagtgagattaatttttagtgttagaattaggggtttgtttgtttttattagtagatttattggtattaatttttttttgttgatatatagttaagtatcgttttttatagatttttatatttagagttaattttgttttgttttataatttttgttattggtagaaggtgataaaattgtggtttagaggttaaatgttttttgtttggtttatagaattagattattttttaatatatttattattttataatattagattattttttaatatatttatgtttgtagttatatataaaaatttggatgtttgattttttgaaagatgtgaatagtttagtaatattgtattgtttatttttatgttattaatttgttggatttgagtagatgttgtttatttttttatttttgagtgggtgggggtgggggaggtgggattttattgtttaggaattttattatatttggttgtttgtattaggatttcgaaggtttttttttttttgagatttttttttgaatgaatttatggtttatttttaaaattttaaattttataaagttttaattagtttaatttagttcgtttattgtattagattagaggttgttaaatggggtagtttttttttttttttattttagggtattgggtatgtttggagttttttgggttgttatatggggaaggggtatgttattggtatttagtagtagaggttaggattggtgtcgagtattttgtagtgtataggatagtttttataataaaggatgatttggtttaaatgttagtggtgttgagatcgaaaaattttgattaagaagtttaatgtgagttattgtgttattgtgtgtgtggattaatgatggattttatttttattaagaattataggatttattaaaattttatattattttgatttatttttatgttataaatattaagtagtttatttttgtttttttagggttttgagttagagataattggatggaagaattttatattataaatttttaatgaagtataaaatagtttttttatattaagtttttaaatacgtatttgaggtaattgttaaatttggtaaatgtttgggttaaattataataatttttttagtaaatatttttatgtaataatagtattattgttagttgattgttttgtatattgatatagtttttgttatattagtgataggtgaaaattagtttttttttaataagaaggtaatttagtgttttaatttgatttaaatgattagtaatttgaaatatatgtattttttggaatattaggtggttttataattataattatttttataaggaattatatattaagtttttaaaaattttttgaaggtttttttttttttttttttgagatggagttttatttttgttgtttaggttggagtgtaatggcgcgatttcggtttatcgtaatttttgtttttcgggtttaagcgattttcgtgttttagtttttcgagtagttgggattataggtatgcgttatcgtttttagttaattttttttttttttttttgtatttttagtagagacggggttttatcgtttaggttgtgttaaattttttagtttaggtgatttatttattttagttttttaaagtgttgggattataggcgtgagttatcgtgtttagtcgaagtattttttagtagtataaaaattgttaatgaataaatgaaataaattaataaatgaataaaatgggaataaaatatattaaataaaatatttgtgttttgtattttaaaaattttataatagttgggcgtcgtggtttatttttgtaattttagtattttgggaggtcgaggagggtagattacgaggttaggagatcgagattattttggttaatacggtgaaatttcgtttttattaaaaaatataaaaaattagttgggcgtggtggcgggcgtttgtagttttagttatttgggaggttgaggtaggagaatggtttgaattcgggaggcggagtttgtagtgagtcgagatcgcgttattgtattttagtttgggagacggagggagattgcgttttaaaaaaaaaaaaaaaaaaaaaaaaaaaaaaaaaaatatatatatatatatatatatatatatatatatatatatatatatatatataaaaaatagtaatttattggggtaggggataaattgtgtttttgtttagaagaagatttttttttttttagaagaagttttgttgtttttgttgttgttatttgtttgtttgtttgttttgagacggagttttagtgggtcgtttaggttggagtgtagtggcgcgatttttgtttattgtaatttttgtttttcgggtttaagcgatttttttgttttagttttttgagtagttgagattataggcgcgtgttattacgtttggttgatttttcgtattttttagtggagacggggttttattatattggttaggttggtttcgaatttttgatttcgtgatttgtttgttttggttttttaaagtgttgggattgtaggcgtgagttattatgttcggttcgaagttttgtattttgaaggtgaatgtttttgttttttttttgattagttattaaaagtgttttttttgtgttatttgagaattatttgagaattattttaagtttatggtatattttagtatttttgttgtttaaaggtagttgtattttaattatgtaaattttatgttgttttttttgtttattatatagtttttgttgaaatgtttatgttatattttattttatttatttatttttttatatttataataagagttaaaggttatattttagtaatgtgtttttttttttgttataatatgttaaatattttaaatttagttatgatgttaaatagagtgaattggaatttttaacggatttcggtaggaatgattatataagatttagggttaaagagagtttgggtgattgtgtaggggtattaggttatgtttagtattatatttggttgttatttaggggagtagttagggttggaattgttggggagtgtaaattgtagtattttttgtttttttgttttagagtagaattgtggtttttatttaggtttaattttagttaaaaaaaaaaattttaatggtttattttttttttgagttatattattgtagagaatattgatttgaaaaaataaagttattaattagaaataaaatttgaattgggtgtagtggtttataattgtaattttagtatttttgggaggttaaggtgggaggattatttgagtttaggagtttaagattagtttgggtaatatggtaaaattttatttttataaaaaatataaaaattagttgaagtgtggtggtgtgtatttgtagttttagttatttgggaggttgaagtgggaggatggtttgagtttaggaggtggaggttgtagtgagttgtgattgtattattgtattttagtttgggtgatagagttagattttgttttaaaaaataaaataaataaataaaaattaaaataaataaaatttgaaaattttgggtatgattttttttttgtattatttaatatttttgatgtttattaggttagtttaaataatttattttttgtgtgtttgtttatgttagttttttgtgacgtgtggagaagtggaattgggagtaattaaattagaatgaaggaagagttgtttgtgaatgtttatatgataaatgataaaattggttttttaagagggatagagtatgtttaagttgaatattgtattatatattataattgggtaaggttgagttatttagatatgtatttatggatgtaattttatttatttgatattttagtgtattgttgagaagttgtatgttggtaaattgattattttagttttgtaagaggttatatttttttttattttaataaggagattgtaggaggttatatttttagttttgtgttaaattttttgtaaagaaaatttttttgtgaattagaatataatttgtaagtttatattgaatttggagtgggatttattgatttattatttaattttatgtggatacgttgtggttattttattagtgtaggttgagtaaaaggtgtgtgtttgagtttgtttttgtaaaattttttatgatagtatttggagagtggaaatgtgaaaaaagatgagtattagtattttttagaagtgttggtttaagtttttatttatttattatatgattttgaatgttattaattaatatatttttaattatttttgaattttgtggtttagttagtgttagtgggagtaagaaaagatttacgtgttcgggaatagtggtttacgtttgtaattttagtattttgggaggttgagatgggtggattacgaagttaggagttcgagattagtttgattaatatggtgaaattttatttttattaaaaatataaaaattagtcgggcgtggtggtacgtgtttgtaattttagttatttaggagattgaggtagtagaatcgtttgaatttaggaggtggaggttgtagtgagtagatatcgtattattgtattttagtttgggtaaaagcgagtttttattttaaaaaaaaaaaaaaaaaaaagaaaaaagaaaaagatttatatttatttgaggtttggaaaattgttgggaagtttttgtatatattaaattagataatgtttatttagtggtgtttttattttattttattttattttggagatagttttgttttatcgtttaggttggagtgtaatggtattattatagtttattgtagttttaattttttgggttttagttatttttttgtcgtagttttttgagtagttgggattataggggtttgttattatttttaattaattttttattttttgtagagatggggttttattatgttgtttaggatagttttaaatttttgttttaaagtaatttttttgttttaggtttttaaagtattgagattataggtatgaattattgtttgtttttggttagtgtttttgatttaaaagagaaatataggtcgggtgtagtggtttacgtttgtaattttagtattttgggaagttgaggtggggggattatttgaggtcgggagttcgagattagtttgattaatatagagaatttttacgtttattagaaatataaaattagttaggtttggtggcgtatgtttgtaattttagttattcgggaggttgaggtaggagaatcgattgaatttgggaggtggaggttgtggtaagttgagatcgtattattgtattttagtttgggtaatgagagtaaaatttggttttaaaaaaaaagagaaatataggtcgggtgtagtggtttacgtttgtaattttagtattttgggaggtcgaggttttagatcgtttgagtttaggaatttaagattagtttgggtaatggtgaaatttatttttattaaaagtataaaaattagttaggtgtggtggtatagatttgtaaagttttagttatttaggaggttggggcgaaaggatcgtttgagtttaggaggtcgaggttgtagtgagttttgattgtgttattgtatttttagtttgggtgatagagcgagattttgtgttaataaataaataaataaataaaagagaaatatatttaataatttgtattatttatttgtgtttgaaatatttagtgttaattttatttttttttttttttttagg

SEQ ID NO: 100 - DNA, 17419 bp, Artificial Sequence
  chemically treated genomic DNA (Homo sapiens)
tttagagaaaaaggaaagggtggggttaatattgaatgttttaagtataaataagtgatgtagattattagatgtattttttttttatttgtttgtttgtttattaatatagggtttcgttttgttatttaggttgggagtatagtggtataattaaagtttattgtagtttcgattttttgggtttaagcgattttttcgttttagttttttgagtagttgggattttataggtttgtgttattatatttggttaatttttgtatttttggtagagatgggttttattattgtttaagttggttttgaatttttgggtttaagcgatttaggatttcggttttttaaagtgttgggattataggcgtgagttattgtattcggtttgtatttttttttttttttgagattaagttttgtttttattgtttaggttggagtgtaatggtgcgattttagtttattataatttttattttttaggtttaatcgatttttttgttttagtttttcgagtagttaggattataggtatgcgttattaagtttggttaattttgtatttttagtaaacgtggagattttttatgttggttaggttggtttcgaattttcgattttaggtgatttttttattttagttttttaaagtgttgggattataggcgtgagttattgtattcggtttgtattttttttttaaattaaaaatattggttaggagtaggtaatggtttatgtttgtaattttagtattttgggaatttaaggtaagaggattgttttagaataggagtttaagattattttgggtaatatagtgagattttatttttataaagaataaaaaattagttgggagtggtggtaggtttttgtagttttagttatttaggaggttgcggtaggaggatggttggagtttaggaggttgaggttgtagtgagttatgatggtgttattgtattttagtttggacgatagagtaagattgtttttaaaataaaataaaataaaataaaaatattattgaatggatattatttggtttaatatgtataggaattttttaataattttttaggttttaagtagatgtgaatttttttttttttttttttttttttttttttttttgagatggggattcgtttttgtttaggttggagtgtaatggtgcgatatttgtttattgtaatttttattttttgggtttaagcgattttgttgttttagttttttgagtagttgagattataggtacgtgttattacgttcggttaatttttgtatttttagtagagatggggttttattatgttggttaggttggtttcgaatttttgatttcgtgatttatttattttaattttttaaagtgttgggattataggcgtgagttattgttttcggatacgtggatttttttttatttttattgatattaattgagttatagggtttagggataattgaaaatgtattagttgatggtatttaaaattatatagtaaataaatgaaaatttagattaatatttttagaaagtgttgatgtttatttttttttatatttttattttttaggtgttgttatgaaaaattttataggaataaatttaagtatatattttttgtttaatttgtattagtaagatgattatagcgtatttatataaggttgaatgataaattaatgaattttattttaaatttagtataaatttataaattatattttaatttataaaagaattttttttataaagaatttaatataaggttaaaagtataattttttgtagtttttttattagagtgaaagaaagtataattttttgtaaaattaagatgattaatttattaatatataattttttaataatatattaggatgttaagtaaatgaaattatatttataaatatatatttgaatagtttaattttgtttagttatgatatatgatataatgtttaatttgaatatgttttgttttttttggaaaattagttttgttatttgttatatggatatttataaatagttttttttttattttgatttggttatttttagttttatttttttatacgttataaaaaattgatataaataggtatataagaaatagattatttggattggtttagtaaatattaagaatgttgaatggtataagaaagaagttatatttaagatttttaaattttatttattttgatttttatttatttattttattttttgagatagggtttggttttattatttaggttggagtgtagtgatgtaattatagtttattgtaatttttattttttgggtttaagttatttttttattttagttttttaagtagttggaattataggtgtatattattatattttagttaatttttgtattttttgtagagatgggattttgttatgttgtttaggttgattttgaatttttgagtttaagtgatttttttattttggttttttaaaagtgttgggattatagttataagttattgtatttagtttaaattttatttttagttagtgattttgtttttttaagttagtattttttataataatatagtttaaaagaagaatagattattggaatttttttttttaattgggattggatttggatagaggttataattttgttttgagataagggaatagggaatattgtagtttgtattttttagtagttttagttttagttgtttttttgaatgataattagatgtggtgttgggtatagtttaatatttttatatagttatttaggttttttttggttttaagttttatataattatttttgtcgaaattcgttagaaattttaatttattttgtttaatattatggttgaatttaaaatatttaatatgttatgatagagaaaaaaatatattgttaaaatataatttttaatttttattatggatatagaaaaatgagtaaataaaataaaatataatatggatattttaatagaagttatatggtaggtaaaggaggtagtatgaaatttatatgattaaaatatagttgtttttagataataaaaatgttgaaatgtgttataagtttagagtagtttttaaataatttttaaatggtatagggaaaatatttttagtaattgattagagaagaagtaaaaatatttatttttaaaatatagggtttcgggtcgggtatgatggtttacgtttgtaattttagtattttgggaggttaaggtaggtagattacgaggttaggagttcgagattagtttggttaatatggtgaaatttcgtttttattaaaaaatacgaaaaattagttaggcgtggtggtacgcgtttgtagttttagttatttaggaggttgaggtaggagaatcgtttgaattcgggaggtagaggttgtagtgagtagagatcgcgttattgtattttagtttgggcgatttattgagatttcgttttaaaataaataaataaataaataataataataaaaataatagggttttttttaaaaaaaaaaaagtttttttttaaataaggatataatttattttttgttttaatagattattgttttttatatatatatatatatatatatatatatatatatatatatatatatatatatttttttttttttttttttttttttttttttttttgagacgtagttttttttcgttttttaggttggagtgtagtggcgcgatttcggtttattgtaagtttcgtttttcgggtttaagttatttttttgttttagttttttaagtagttgggattataggcgttcgttattacgtttagttaattttttgtattttttagtagagacggggttttatcgtgttagttaagatggtttcgattttttgatttcgtgatttgtttttttcggttttttaaagtgttgggattataggagtgagttacggcgtttagttattataagatttttaaaatgtagaatataaatgttttatttaatatgttttatttttattttgtttatttgttgatttattttatttgtttattaataatttttatattattaaaaaatatttcggttgggtacggtggtttacgtttataattttagtattttgggaggttgaggtgggtggattatttgagttggggggtttgatatagtttgagcggtgaaatttcgtttttattaaaaatataaaaaaaaaaaaaaaaaattaattgggagcggtggcgtatgtttgtaattttagttattcgggaggttgaggtacgggaatcgtttgaattcgggaggtagaggttgcggtgagtcgagatcgcgttattgtattttagtttaggtaataagagtgaaattttattttaaaaaaaaaaaaaaaaaaatttttaaaaaatttttaaaaatttaatatgtagttttttgtaaaaataattgtgattgtaaggttatttagtgttttaagaaatatatatattttaaattgttagttatttaagttaaattaaaatattaaattatttttttgttgaaagaaaattgatttttatttattattaatatagtaaaagttatattagtatataagatagttaattgataatagtattattattatataagaatatttattaaaaaaattattataatttaatttagatatttattaaatttgatagttattttaaatacgtatttgaaagtttaatgtgaggaagttattttatgttttattgaaagtttataatgtaaagtttttttatttaattgtttttaatttaaagttttaagaaagtaaaggtaaattgtttgatatttatgatatgaaaataagttagaatagtgtaaaattttaatgaattttataatttttagtgagggtaaagtttattattaatttatatatataatgatataataatttatattaagttttttgattagggtttttcgattttagtattattgatatttggattagattattttttgttatggggattattttgtgtattgtaggatgttcggtattagttttggtttttattgttagatgttaatagtatattttttttttatatgataatttaaaagattttaggtatgtttaatgttttgaggtagagggaggaaaaaattgttttatttgataatttttgatttaatgtaataaacggattaggttggattggttaaggttttataaaatttaggattttaaaagtggattataagtttatttagaaaaaggttttaaagaggaaagaattttcggagttttggtataggtaattaagtgtggtaggatttttgaataatgaggttttattttttttatttttatttatttaaggatgagggggtaggtagtatttatttagatttaataaattgatggtatgaagatagatagtatagtattgttaaattgtttatattttttaaaaagttaagtatttagatttttatgtgtaattataggtataagtgtgttaagaagtaatttaatgttgtaaagtaataaatgtgttgagaagtaatttaattttgtaagttaaataaaaaatatttggtttttaggttataattttattattttttgttagtagtaagagttatgagataagataaggttggttttgagtatgaggatttgtaagaagcggtgtttaattatatgttaataaaggagagttgatgttagtgggtttgttggtgagaataggtagatttttaattttaatattgagaattagttttattattggaggattatttaattatagatttggtcgttagagttgattagggttttaatgaatagttttaggttttttgtagttttttggattattagaggggaaggtagaaagaatggggaaggtaagggttttttatttggagggaagaatttgttaagagtttgtaatgagaaaagttttataaggatttggtttttttgttttttaaaaagattgaataaaattttaggtagaaaaggttaggtttaaaaggttgtttattaaggagggattggtatttgggtatttaaatttaaagattatttataatgttaagttatttattgtagttaagattaagtttttgataggttttggtaaaattttttatagaaatgtttttttattttttgggattttttaagtattagatattaagtagtacgtttttcgtttaggtttgtggtgaggggtaaagaaaaaaaaaaagtttagttagtaaagtaagtaggtttgatttgtttttaattagttaaaattggattataattttaaaaatgattttttgaagagaatttgtttgggtgttttttaattagattgatgggtggaatgatttttttataatggaaaggttttagggagaattaaatttagggtgttttttgttggagggtagaagtttgtaattttttttagtaagttaatgataagtttatggtagggaaagaaatgtattatcgagtttttgttatttattttggaatatttgggtaagttatttagtttttggttaaagtgttataaattgtaaaattgagggtaagggtagtagtcgagtggttgaggaattttgattgtggtatttttagttatttatttttttaaggttaaggatttatagggtgatagaagttgttttttggttaattaaggggtgtaaaggagagttaatcgtatagtgtaggggtaatgggggttttttgtattgtggatgggacgttaaagaagtttgttttgagagttttatatttttttaatttttggggtaacgttaggaagtagatagtttttattatttttattgtatagaaaggaaagtgaagttaatttttttaaggttatataagtatttttgttttttaatttttattttattaatttttattgagttaattagaggagaagggagttatttgtttttattttaaggatttttttttgtattaggttagttttttttttagaagattttttatgtaaataggggatgtaatagggaattatagatttttgtttaaaattttattatttaaattttaaattgtttgattttaatttttttgatggataaggatagatatttatttgtaaattatatttttaattaggtgttatgattatagtagttggttgttagttttgggttttgttgtattatcgttgtaatttgtttaatagtttggttggggttttagttgaaggttttagtttttttggaatttcgattttttttgtataggtttttagaattaatttagttatgatagttaagtttttatgtaatttttgagtaatttgtattttggagtttattataggtaaattttttttttttttttttttgagatgaagttttgtttttgttgtttaggttggagtgtaatggcgttattttggtttattggtttattgtaattttttttttttaggtttaagttatttttttgttttagtttttggagtagttgggattataggtatgggttattatgtttagttaattttgtatttttagtagagatggggttttattatgttagttaggttggtttttaatttttgattttaggtgatttttttgtttgggttttttaaagttttaggattataggtatgagttattacgttttgtttagataaatttttttaagtataaaagggtttatatgtatttaatttataggataaagtaaaagttttatttatgttaatttagtaattaagaagatttgttttttattatggtaagtaaattatttttataaaaatagtttttttagttttgtagttaaatgtatagttaaggttttaaatttttatttttgattattaggataaattttaattttaagttttaagattataagttagtttttaaaggtatagtttggataaatataaatattatttttttatttaatgagtattttttaagtatttatttattaaaatttattatgtattaataatttttttaaatgttttataggtattaaatttatttaattttaataattttatgagttaggtgatattattattttaatatatagaagttaaggtatagaggtaaattgtatgatttagtgatgtatagaggaggtagtatcgtgtttaggttttggagttattatttatagcgagtttataaatatatttaatttgttttgtatttggttagtaaatattcgtagtatttatttaaattatttgtttttttataattagtttttttagaaaggagatttaattaagaaaaatgttattaatggagagagtaggtttaattatagtaaattaagggaaggaaaaattaaataaattatataaatgtagtaagtttttttttgaaaggtttatttatagaataattatgtttttttgtttataaagtaaggtgggttttttaatattaatgtatattttttttttattttgtataattttttaaaagatattatttttttgtttagggtagggttaggtttttttatttaggagtttttattcggttagttttttatagggttattgttattgattttttaaagtagtaagttagtaattggtgaggataaaggtttatggtataggttgtgtttttggttaggagttattttttttataatattggtaggtttaaggttttattttttttaagtttttgttcgtaagttatttttataaagattatgatttttatatttaaaattgtagttattatattatagaaatttttgttttttttttttgttttggtgttttttttgtgttttttattagtttataatgtgttttatttatttaaatgtttgtttttatttattagtatgtaagttttatgagggtagggatttgggttgttttgtttattattagatttttagagttttgaagattgtttggtttaggggatatatatagttatttgttgagtaagtgaataaatatttataaagaatagatatttgtttttaatttttagattttttttcggttgttaaatttaggttgtaaatttagaatttttcgtgagggagaaaaggggttgttatttttaaagaaagataatttggtaattaaatttattatgtaagtatttagttttttatagagtagagtaggtagagaaggaatttggaatgttgaattttgttgatgttcgagtttttaggaaggtataaaaggagaataataatagaagaggacgagttagggatagtatttttagtagggtgggaaatatgttaatgagaggaagattgtaaagaaaaagtaaagcgttagcgggggcgtagtggtttatatttgtaattttagtattttaggaggtggaggtggatagattatttgaggttaggagtttaagattagtttgattaatatggcgaaattttatttttattaaaaatttaaaaattagtcgggtatagtagtgtatgttcgtagttttagttatttgggaggttgaggtaggagaatcgtttgaatttaggaagtggaggttatagtgagataatatcgtgttattgtattttagtttgagtaatagagtaagattttgtttgaaaaataaaaagaaagaaagaaagaaaagaaaaagaaaagtttacgaaattttttttagtaagtagtaagtgttggttagaatgaaaaatattatatattgggtgaagattttagttttagttgagttattgttatttatttttggataaattatattatttttttggttttaaatgattttttaattcgtaggatggaatgtgggaagtgggttggatttttaagaaattttaggatcggtgtagtggtttatgtttgtaattttagtattttgggaggtcgaggtgggtggattatatggggttaggagttatagattagtttgattaatatggtgaaagttcgtttttattaaaaatataaaaattagtcggacggggtggtatatatttgtagttttagttattcgggaggttgaggtaggagaatcgtttgaatttgggaggtggaggttgtagtgagttaagattatgttattgtattttagtttgggtaataagagtgaaattttgttttaaataaataaataaattagttggatatggtggcggacgtttgtaattttagttatttgggaggttgaggtaggagaatcgtttgaatttaggaggtagaggttgtagtgagtcgagattacgttattgtattttagtttgggcgacgagtgaaattttattttaaaaaaaaaaattagttaggcgtgatggcgggtatttgtaattttaggtatttaggaggttgatatgagagaattgtttgtatgtaggaggtagaggttgtagtgagttaagattggatatagtaagattttattttaaaaaaaaaaatagattttaaggtagtagttattatgtaaaaaaaaaaaaagataatgaattatttatatatatattaattaattattgattattaatataatatatatcgaatatttattatgtgttaggaagaattataaatgattatttgttaggaatttatttaattttattaatattttaatgatttagatattatttttatttaatatttgaggaaattttggtatagaaaggttaattaatttgtttaaaattatataagtagtaaggtaggaaatagggtttttaggtgtttaggatatagataaaaataagataatatatgtatttgtttttatggagttgataaatatatttaatttgttttttaattaacgaaagtatatttagtgagtatttatttttagtattggtttagatgtattattattgtattaaattatttgtattattattatgtattaaattatttttttataattagtttttttaaaaggaagatttttatattaaaataaaaagttattggaaaaggaagtaagtttgaatataagtaaataaaaatagaaagtaaagtagaaatatagtttagtaagttatatgttgaaaagtattaagtagtaagtattgtgattttttttttttttttttttagacggagtttcgtttttgttgtttaggttggagtgtaatggcgtattttagtttattgtaatttttgttttttaggtttaagtgatttttttgttttagttttttaagtagttgggattatagatgtttgttattatattcggttaattttttgtatttttagtagagatggggttttattattttggataggttggttttgaattttagattttaggtgatttatttatttcggttttttaaagtgttgggattataggtatgagttattgggttcggattttttattatcgatgattttgtaatttatttaaaaatttattataaagttaggagttataggataattataatttagtaattgttgtggttggtaatagtaatttatataacgggtgatgtgaaaggttttaagagtaaatttagtaaggttatatagaatatattttttttttttttatttattagagggaatatattttttttttttttttttatttttatttttttttattagttattttttagataaaaagtagttagtgttattttttgggagtaaagttggtaacgatatttattaattaagtatttagatgtttcgtaagggtagaataggtagaggttaagtggaatgtagaatatttttaggatttaggagttaaattacgttttaagtaattttaggattagggtagagagatggttgttagagagaagtacgagattgaagagaaaggaaaaatgtattagattttatttagcgtatgataagattatggtatagtgggaaaagttatgagttggaaggattttttgttattattagttttgtagttttgttaagttttgttattttattagtttttatttatttatttttaaattaacgggaattaagtagattggatttttgagttttgattaggggggttttaggaagtcgtaattatttattttttcggtagaaagttattagtagttgcgcgtttgggagtatagtcggtataggattttttttcgaagtataggagttagcggttatagttattaggtagtttatttgtaaacgtaggttgtgttcgggttttttttttttggttgtaggtttttaggtgttatgggtttaattttttcgttataagtgtttttttcgtaaaaaatgggttcgggggatttgtatatttttagagttttcgtttatagttttatatttaataataatgttaggtgtttacgcggagatttttttttcgtttaggatttttgttggcgttatggtttttattagttcgttgtttacgatggatattattaatatcgaggttttatttttttcgtagttaagtaggataatttaatttacgtgtttagggattggttaggggattatattattgcgtttgcgtttttgttcgtttttttttttgtagacgcggtggcgtatgcgtagttcggaaggattcgagttttttaattaatcgagagttaataggtcggggattgcgggacggaagagggaggggaagatgaagaaaatcggtgatgaatggttggcggaaatgattggcggaaagaaagagttagtttatagtgcgtttttgtattcggcgggaaattcggtcgaagagggagttggaaaggatttcggaattcggtcgtaattttagttaattagggagtagagttgcggggcggggttggggcggggtagtttcgcgggagatagtttcgcgggttcgggaggcgagttttcggttttcgtttagtttttggggacgcggtggcggggtttgaatcgtttggtttttagggagttttgggcgggttttcgtacgggagcgtggtaggcgttggattcgatagtagatgtggaattggagagtttggcgcgtttttatattttgttatatatttacgttattagattggggtcgggttttttcgcgttttgttttggagggtttgggtttgggtttagtatagcgtttttagaatttttttagttgaatttgacgtttagtcgtaggtgaagtttagttcgttgttttaggtttcgtcgatttggaaggagtgttagagttggagcgcgcgtggttttatcggtgttggggttatttcggggttgttagggtttatggagggtcgtagtttggattttgttatttttacgttttcgtttcgtagtaagtttggggttggagaatttacgcggttttcgtaagttatatgttagttgattttcgaggagggatgttttttttttttaagcgtttacgttggagaaggagtaagatggataattgtttggggagtttgatagggcggtggtagttgggatgttggagaggattggttttttgtgttattgagtttaaggaatatgtttgttttgttttaggaatcgcgtttaggttatagttattttagtagagttttgaagatgcgtggtttaggttatttaggatttgattagatatcgggttttttttataagtcgtttattattggtagagtttatttaaaattttttttgtttgtttgtttgagacggagttttattttgtcgtttaggttggagtgtagtggtacgattttggtttattgtaattttcgtttttcgggtttaagtagttttttgttttagtttttcgagtagttgggattataggtattatttaattagttcgttattacgttcggttaatttttgtatttttagtagagacggggttttattattttggttaggttggttttgaatttttgatttcgtgatttattcgtttcggttttttagagtgttgggattataggcgtgagttatcgtatttggtttaaaattgattttttattaattttggggtttttaatattttttttttatttttaaattttgaggttatttatagtagttttatatacgggattagataattttttgtgattttttatttttggtaattatttttaatatatgtttttttgtttttgagacggagtttcgttatgtcgtttagggtggagtgtagtggtatgattttcgttttttgtagtttttgtttttcgggtttaaatgatttttttattttagtttttcgagtagtttggattataggtgtatgttattacgtcggttaatttttttatttttggtagagttggggttttattatgttgattagattggtttagattttaagggattagttttttttggttttttaaaatgttgggataatgggtatgagttatcgtgcgtggttttaaagttattatttttaaagtttgtataagtgatatgttaaaggtatagatttagtaatataatgttattataataataattttaaaatatattgttttatattgtgttgtatttaaataagtgaaattaagaagaaaattgaaggaaatgtttttggtaaattgtagatagtgaattttttgttttatattattaaataggtattgattattttagtttttttatttgttgaggaagatggtagaaatttcgttttatagagggatagattttgaaggataatatttaaagttgtatagttgtggttggtataggttttaaatttgatgttttttttttaaatttattgtttttgttattttaatagtttggtttttgatagttatttatgtatgagttgtataaatcgtttatttatggagtaaataattattgagtggttattatgttaatagtattgttatagatgttagagatattttagtgaattagtaaagtttttgtttttagtttatattttggtggaggagataacgattaagttaaagaaatatataggttaattttagagattatgatatgttatattttaaaaataggtaagttaagaggataggtagtgatgttgggaggtgggaaagttttgttttagaaatgtggtaagagatttttttgggtatttgattttagtagaaattttaatgaagagaggaatttggaatgtaaaagaaagaaagtagggatttgttttgagtaattggaaagatggaattgttattcgttgagttgaaataaagtaaaatgtaggattaggttttggggttaagattatgaattcggttttagatatttttagattttttttagatatttaaatggagagaagatatttaaatttatgggattgaatgagatttaattaagggtattgtaggtagagagaggattaaagattgatatttagaattttttagtgtttagaatgtaaggagataggaggaattaagagggaagattgaaaaggagagtttagttgggagttgtggttatatttttattaattttagtattttgggagattaaatataggaagattatttgaatttaggagtttgtagaatagttttagtaatatagtaagattttgtttttataaaaataaaaattaaaaaatttgtttgtaattcgagtattttggaggtcgaggtgggtggattagttgaggttaggagtttgagattaatttggttaatatagtgaaatttcgtttttattaaaaatataaaaattagttgggcgtgatggttggtatttgtaattttagttattcgggaggtcgaggtaggagaattttttgaatttaggaggtagaggttgtagtgagtcgagattacgttattgtattttagtttgggagatagagcgagattttattttaaaataaataaataaataaaaatttaaaaagttagttgggcgtggtggtatgtatttgtagttttagttatttagaaggttgaggtgggaggattttgtgagtttaggagttggaaattttagtaagttataattattatattgtattttaatttaggtaatagagtaagattttgttttttaaaaggaaaggagagtttagtgtgttttaaggaaaattttaagagtattttattttagaatataagtgaggaggtttggtatggtgttttatgtttgtaattttagtattttgggaggttaaggtgggtggattatttgaggttaggatttttagattagtttgataaatatggcgaaattttcgtttttataaaaataaaaaaattatttaggtgtgttcgtttttatttttaattttagataatagggaggttgaggtaggagaattgtttgaatttagggggtagagtttgtagtgagtcgagataggttattgtattttagtttggtaatagagtgagattttgttttaaaaataaataagtaaataaataaaaaaaaaaataagataagtgaagaatgtgttttatggaaaaagaggtaattaattttgttaagtgttgtaaattggttaaataaagaatgaaaattaattttttatagtaaatagaaggaaaaaatatttttatttaaatgtttataaaggtagttgttagaaaaaatgtttattttttgtagaggtttcgtttttataattttttttaggggtaatttgatatgataatatttacgggaaaaaaaatgtttttttttttgagtcgttttgttattaggttggagtgtagtggtatgatttcggtttattgaaattttcgttttttaggtttaagtaatttttttgttttagttttttaagtagttgggattataggtgggcgttattatatttagttaatttttgtatttttagtagagacggggttttattatgttggttaggatggttttaattttgatttcgtgatttgttttttttggttttttaaagtgttgggattggtataggtgtgaattattatatttggttcgaaaattttaaatttgtattttttttgatattgtaattttatttttaggattttttttttttggataggattttattttgttatttaggttggagtgtagtaatataattagtttattgtaattttgaatttttgggttaaagtgatttttttgagtagttgggattataggtatatgttattatttttgattaattaaaaaatttttttgtagagatagttttgttatgttgtttagattggtttttagtttttggttttaaattatttttttattttgattttttaaaacgttgggattataggcgtgagttattttttttagtttaggaatttattttaaagtaatatttatatataaagaaagatgtataggttgggtgtagtggtttacgtttgtaattttagtattttggaaggtcgaggttggtggattaattgaggttaggagtttaagattaatttggttaatatggcgaaattttatttttattaaaaatataaaaattagttgggcgtggtggttagtttttgta

SEQ ID NO: 101 - DNA, 11836 bp, Artificial Sequence
  chemically treated genomic DNA (Homo sapiens)
  unsure (4234)
ttgtttttataaaaattatttatgtttattgtaaaataattaaatagaaaatttttttaattagttattaattgatgaatatttagattgtttttaatatttgtaattaaaagttatgttgaatgagtattttatgtatttatttttttatatttttaattatttatttagaatatttaaaataaaaattgaggggttaaagaatatgaaattttaatttgtaatagtgatttttaggaaaaatgtattaatttatattttaattagaaaagtatgtgggtgttattttatttatagttttattgagttttattagtattttttattattaatatttttaatgttggtttaaataaaaggtaaaagaaatgttattttatttttttttttaatatttttgattagtagtaatgttgaatatttttttttgtttaatttatttgtttatttttggtttgtttgtttaaatttgttgtttatttttttattatagtatttatttttttattgatacgtgtttttagtgattttttgttgattataattattaatttttttttttatttgttatttggtttttaattttgtttatggttttttttgatttggggggtggggaatgaaatttaatttatttgtttaggatttattttttttaagtattttattatggttattttaggattatattttgtttatgattattttttgtttgggatggaattaatattattggttaatgtttttgattagattttattttgagttggagagtaattttgataatcgatttttaaatgtatttgcgttaattatatatatatgattatgaaatatttataagaattttatttttttttttgtaaacgagtattttttttttgtattgttatttaattttgttttaagattgttgttgggattaataagatttatattttttaaatttaggttagaaaattttaaaatgtagttttttaggttatttttttggtttggtgaagtggaagaaggtatttggtttggttgtaatagtgaagtagatattttttttagttaaatattttttagaatataaataagaaagaagtagttatgttattttttgattttttgaagaaaatatgaagttaattaattacgtaaattagtatgggtaaagtagtttaagttaattatttatttatttattaaattaatagtatttatttaggaacgattcgaagttaagtattattttaagtattgagaatatagtagtaaacgaaagtgaaaaagtttttgtttgtttagagtttatattttagtggggtgaagtaaataagtggataaattgattttttatttttaaagttagatggtgtaaaggttatgaagaataattagtagggtagggaggtagtgatggagaagttttttcgatatagagagtaggaaaagtttttttgtagtaatagtatttgagtagaaattttgaattagggagcgagttatgtagttattagggtaaataatatttagaaaagtaataggtataatttaaattaattaagatgtgtgttagtatttttagttataaatatttttttttttttgttttttaattttagagttatgaaaatttttttttttagaagaaatagtttttaagatagttttattgtaatatgttagaagaaatgttaaaatcgttattgtggttaaattttgttaaaatggatatattataattattatattatgttggtttttttgtaaagtaaaggtgataggtgataagtattaagaggtatattgagaaaaagtatgggttttggtttgtgttgtagtagtttgttaagtatgtgaatatgggtaagttatttaaggtttttgagttttaaattttttttgtggaaattgtgtattgtagtatttatattatagtattgtattgtagattggaaagaaatattaatatatagtgtttggtataaattagggtttaatgaatggtaatattattaatattttaattgaatgttgtattttaaatttaatattaaaattttatttaaaaattagttgtgatagattatattttttaaaaatggttgtagtagtatttttggtttatttttttaagtttaggtaggtttgttaattatttttaaaaataaagcgtgatggaagtaatgttgtatgattgaggttgggtttttaaaaggatacgttagtgtaagtttttattttgagatgtttacgttgaggagattaaattattgtattgtgagtaagttaatttaatttatgtagagattatatatagagaattaggtggagaggaatagaggtttttagttgatagttagtattaattattagattttttagattttagattggtttttgagttgagagtagagataaggtgtttttgttgtgttttgtttaaatttttgttttataatataataattggttattttatattattagtgaattggttaaagttagttttttttaggataatattgaaggaggtagttagaggtggatattgaaggttttgaaatagttatatggtaagtagttttaaaattattttttttttttgggagtatgagaagtaattatttataaaataagttagattggttttgtataggggtttatgtttgtaattttggtattttgggaggttaggagtttaagattagtttggttaatatggcgaaattttatttttattaaaaatatataaattagtttggtgtggtggcgtatgtttgtaattgtcgttatttgggtggttaaggtataagaattgtttgaatttaaaaggtagaggttataacgagttaagatcgtgttattgtattttagtttgggtaatagagcgagattttgttttaaaaaaaaaaaattatattttaatgattttttaatttatttggataatgtttaaagtttttatagagtattttttttttatttttttgattttatttattattttttcgttgtttattatttatgatggtattatttgtgggtatttttgaatgggtcgttagaatatattagcgttaagagagtaggggtttttttttgtttatttttatatttttagtatttagaattttgtttggtatttaggaggtgttaaatgttaataaatataatattcgttgaatgaaataaaatagtgattgggtaattaaagaaggttttattaaggatttgatatttgagttgagatttaagtgattaagagttagttacgtagatttagaattagagatttttaggtaaaggaaatagtataagtttttaaaataagaataagtttgatttattgtaagaatagaaagagtggttggagtatagtgaggagaagtagaattttataggttatggtatggagtgtgtaatggaaagtcgtaggagattttttttttttgatacggttttattttgttgtttaggttggagtgtagtgtgcgattatcgtttattgtattttcgattttttgggtttaagggatttttttatttcggtttttaatttttttttcgagtaattgggattataggcgttaaatattaggtttagttaattttttttttttttttgtaaagacggtgttcgttttgttgtttaggtgggttttgaatttttaggtttaagcggattcgttcgcgtcggttttttataagtgttaggattataagcgttagttatttcgttcggtcgttataggagatttttaaataaagtagtaatacgatttgattttggatttgtgttgaaagtagagtaggtagggtttatagataattgttatgtaaaaagagggaaaagagttaagaaagattttaaatttttggattaagcggtcgacggatgacgttatttattgaaatgggtaagatcgaaggagaattaggtcgggagagtgaaattttagatggttatggataaagtagataagttagtatggtgtttataaagatattaggggaggggacgtttatatataggtatataggtatttaataatttttgaaaatagattattaaaataattatttgtttttttttaagtaaataatttaaggaaaatgacggttagtcggtaagttcggagtcgtacgttcgcgttagggttcggttttttatattaaggggcggaacgtgcggtatcgtttttcgtttaggttttatttcgtatgtcgagtttggtttaatttntttttttattttttttagggcggtaaaagtcggaaagtgggagtagatgagtatatattcgttagttttgattttttttaaggttttttttttttgtattgttttcgtttagtaattgttattgtttatcgttttcgagtttattttttcgtcgcgtatttgggtagaaaagttcgttcgtgacgttattaagtttcggaagttttttggcgtcggcgtaagggtcgtcgggaaaattattgagaggttatcgggaaattattgagaagtttcggaggatcggtttgagcggaggcggagattagagcggtcgtcggtacgattcgtttttaggcgtacgacgatcgcggttcgggggttttgagtggttaaagcggcggtattttttgcgtggtttcggaaggatatagagcggaaggcgggagaaagaagtagtcggtaggcggaggtagttcgagggggcggttgtatgtgtgttagacgttcgtagtttattgagtttttttacgtcggttgtcgtagcgtttagttttattcggcggttttttttgcgttttcggggtcgtggcgagttagtgcgtttgcgtgtcggtttattcgcgcgttttgtagttgtttttgcgtcggttagcggttagatagtttttgtagcgtttatcgtttggtttttcggtttcgcggcgtatcggagggtagtatgtcgcggcggcggtatagcgacgagaacgacggtgagtgtttgcggttcggttacggaggtcgttttcggttgggagtcgaggttcggcgtttttgggtgtttacggaagagattggaagttttttttttcgggaacgtgcggggagtcgcggagggaaagaggagaatatggtggcggtgtggtcgggcggtttttagaaagcgatttttttttcgttttagttttttgagttaagggtcgattttcgggaaagaaggtttggtgaattttatgggtagatttttggtttttaaggatgttttagaatttcgttcgtaaaattacggagtagggaagtatatttgtgtttgtgttgtcgttttttagggatttattggttttagtgtttcgttttaatttttaaagttgtatttgaaaagggttcggaagaatttattgaaggaaaggattgagagattttatgagttgtagtttgaattttgtttcggtagtggttattcgttgattttattttttttaagttgtagggaaagaatattgttttatttgcgtttaagaggtttttaataaatagatataggttattgtagattttgaattggtcgtaagcgtattttttttgtgtgagagagagtgttagaaaattaattttaggtttttgagagagttagaataggggtttttattttcgtttggatgattgtgttcgtggagattagtgttgtttttataaagatggaataattttagttttaataataataaaaaaaagatgtttatattatatataagttttataatcggttaaaaatataaatttatatattaaaaaagtaaaatttagagtaattttattgttaatattttagtgtattgttttttgaagagagtgtatagtagtggttaagagatgagattttggaattagagggtttaggtttaaagttagattttattatttatttggtgattttgtttaggttatgaaatttttttaaattttagtttgtaatatagaagtaatgatatttatattttttggtttttgtgaaggttaaatgaggtaatatatattagtaataatgatgttttattatttgttaacgtttaagaggcggtaaacgttagtagatgttgttaatgtaagaaaaaaatttataatagatattttaaattgagtaaattttatttattaacgtttgtttttttttgagtgttgtggtagttgaggtggaggtagaatcgtatgtatttagttttaatagtgaaatattagatttttacgaaggaatggtttgagaggatattttagtttagttttttatttgatatttaagggtttagagattgagtataattaagatggagggatagttgttagtttttaaatattagtaagagcgaatttagttcggggttttttttattatataggtataaattaaataattatgttgcgtgttttgatttttaatacgaggttttttgtgtaatttttgtataaggtatagaaaatataatttttttttttttttttttttttttgagacggagtgttattttttgttaggttggagtgtagtggcgcgatttcggtttattgtaattttcgttttttaggtttaagtgatttttttattttagttttttaagtaattgggattataggcgcgggttattacgttcggttaattttttttttgtttttgtattttttgtagagacggggtttcgttacgttgtttaggttgattttgaatttttgagtttaggtgatttattcgtttcggttttttaaagtgtcgggattatagatgtgagttattgcgttcgtcgataatataatttttatatgttttgtaattgattagttaaaaattaatatattttttaagttattatttgggggttggagaatttgagttttttgtttttttttttgttgttttaatgtttttttttttttatttagaggtaatttttaaagagagaggaaatgttattgtagggtattttagagaattggaatgttaatatgtagaaaaataatttttgttttggttattgggagatttatataatttttttggagttggtttgtttttaatattagttggtagttaaattattgtttatttgggttttgtcgcgagaattttagagtaaataagataagtaaaataaagtatttattaagtaaaggtttttatggttgatattttagtgtgggagaggtagatataatttatgtttgataatatagtaaatttgaaatttttgttagttgttataatttggataacgatcgttggagtttattttatatagtgatttgaattagattattttggatgttttttttttagttaaaaatttattttttaaaaaataaattttagaagtttaaggattatagaaggttattttaaaatagggtaggaattattatagttagaattaaatagatgtatttgagtatttttggataattgttagttgttgttagttattgttttgatttttcgtatgtttgattttttatatatagagtgtgtgtatatatataaattataatagaatgtattatatatatttatatattatataaatttatatttatatattataaatttatatttatatattatataagtttgtttattataagttttatataaatatatattttaatatatattttatatataattatatattgtatatatagaagtaagtatatggaaagtaatatatatatatatatatatatatatatatatatatatataaaattatttatttaataaatatttaatagtgttaagttttgttttaattatttgttatatagtagtggataatataaagatagagttttttttttagagtagagagaagatagttaagtaaagtatagtgtattatatagtgataggcgttatggagtgatattaggtaaagaggggagagatttttgtgagggagaagttattattttatgtaagttgattagagaaggtttcggtgtgaatggtatttgaataaagatttgtcggaggtaaggtagtagttatatagttgtatggggaaaagttgtgatttaaaggtaattatgggtataaaagtttgaagattatagggtttttgttatgttaatagaagagtaaggaggttagtggtgttggagtagagtgagtgagggggaagttgtaggagataagattagagagatagtagagggttgtattttatagggagattataaaattatatttttgtgttgagattcgattattaaagattaaggggggtaggattaggaggttatattaatgaagtttatgtagtagtttatttataaataaggaaaaggaaatgttaaatggaaagtaatgtgtatggatattagtttagtgttaaattttaattaattgtttagatttgttttaaaaatgtttttgaagttttttagttattatgggatatgtagtttattgtttgtttttttaagaaagtatttagattgtttaaaattttagttagaaataatacgaatataattttgggaatttgggtaatttataaaaattttagatttgttgtattagttttatttaagttttttagaattaggtttttgttttttggattgtggttgatttttttatttaattaaagaaaaaaatagaagtgaaaggatttgttattttgagagagtatagtttattttagaagtgatggttgtttgttttaagtttgcgggtttaaggtatgttattttttaagttgtttaatattaaaatagatgagttaaaaagaagggaatagtgtgtttaaggtttaaaaacgtaatgttgaagttgttggttttagttattttatttttttattttatagggttggtttttgttttttattttgtgggtttaaaattttttgtaaggttataagatgtatagtgtattcgtataaaattaggattgatttatagaggggaaatttatttggtttattaagatttttttagatggattttatatttgtttttttatattagttaagtttgtttgagtgaagtggtaatgttatttttaatttatattttaaaatttttatatagttaaattttaataaaaaatttgtttttgttttgggaattattatagatacgttttttttagggtatattgagcgaattttttaaattgtattcgtattgttttattttatttttttgtttttttatttaggttgttttatgagtttaatattatgtttttgttcgtaagtttagattttgtttgtagtttttatttttttatagttttttaattattaggtgaaagtggaatattttttattttttaatattttttgtttttttttattttttagataaatattgttttttaatatagttaaaatgaataaagggtttgtagtttagagatgtgattatgtatatgtattttttagttgttttttagaaattatattttttttttttatagtattatttttttttttttaagtttataagagggtttaggagggttgttttaaaggttgtggtatgattttaaattggaataagttagttggaaagttaagttaggaagattgtagaggtggaataaagggttggtaaaatagatgagttagaaagaagggaatagtgtgtttaaggtttaaaaaatagtaataaaaaataattgtttttatttagttagttttttagtatttgtatttttttaattttattgaaatttggttttgaggagttttgttttttagaatacggttttttaatattagtattattgatatttttggttagttatttgttttgggagatgttttatgtaacgtgagatatttagtagtatgtttggtttttatttattagatgttagttgttttttttagttttgattattaaaaatgtttttaaggtttgttagatgattattgggggtaaaatttatattttgttgagaattattgttgtagaagaaggttatttgaatgttttagttggtagtttgcgtaaatattatattaattatgtttttttttaataagtgaattttggaaatgaaagatttttgtgtgaaatttggtattttgggtggtggaattttgataggttttgtgatttaggtttgatttatatttaagaattaaggtttttgaatttttgtgttatatatgtttataattttatataggtagatatttttaggaataaatatattttagtttttatgttgtatgcgtattatattttttgtggtattatttttttaaaattatagttagtggatatttagttaggttattatggtaattaatgggttgggaagttgacgtatagagtgttttattttgtaatttttataatatttttttttagattttatgtggatagtaatagattcgttttatttagttttagtttatgtggtatttgaagattattttagttatttaatagatttaatattttaagtttagaatagttaggtgttgtgttttatgagaattattatatattatttttaagttaagtgttttataggtaagtaagtgattatgaattttgtaataataatttttttggttgtttagatttgaagattgaagttatatgtaatttgttattgtgtaattatatatttaattgtagatttttattattaatatcgattttttgtatagttataggtttttgtttttttgtttatatgtcgattaaataattgaattaatggaagtcgaaaattggattgtattagattagttaaagtgtttagtagtagtattaggttttatatttaatattattattttaattttttaagttttatgttatattataaaaggatttaggtgagtgtgttaaggttttaaataaagtggtaagagatataaatagtaagggttttaatagataggtgtttgaggttaatttttagtatatttttatttaatttgaattgttgagtaattaaaaagatagatgtttggtaatgattttagaatggtagatttaaaaaatatagagattattcgaatgatatggtttttaaataaagtagttattagtaatttagttaataaaagttagttaaagtaggaattgtaaaacgtggtttttttttttattaattttttgatatagtgtttaggatttttttttgaatatacgtatattgattgtcgtttttattatttaggataaattatatcgttgtgttgtattatatgtagaattgaaattgttaattgaagatttgagattagagtttagaaatatgtgaagtaagtgagaaattttaatgttttatgttttttttttttattttttgaagtttttttttttatagttgatatgatagtttttttttttgattaagtttttttaaagtattcgatttggttttgtatttttattttgttatttatataatatattattagattaatgaatattattggtattaataggtttcggaataagtaattgaggattagtaattaatttaagttaaaagaatgggagtagcggtatatgagtattttaattattagtgtttaatatgttgttggtagttttttagtttgtttatagaaatggatagggttgttgattgtatagttttatgggtattatttatataaaatttaatataaataatgttttttggagttattgtatatagtggttttgggaatgggaggttgttggttaatttagtttagtttgagaaatggagggtttgtgaagagtttttattttgtaaaaatatagggtttggtagaaaagagattataatttaaaaaggttaaataaaatttgtgatagtagatttattatgtaatgttaattttttatgttgtt

SEQ ID NO: 102 - DNA, 11836 bp, Artificial Sequence
  chemically treated genomic DNA (Homo sapiens)
  unsure (7603)
agtaatataaaaaattaatattatatgataaatttgttattataaattttatttaatttttttaggttataattttttttttattaggttttatgtttttatagagtagaagttttttatagattttttattttttagattaagttagattaattaatagttttttatttttagagttattatatataataattttaggaggtattatttatgttaaattttgtgtgagtagtgtttatggagttatgtaattagtagttttgtttatttttgtggataagttggaaagttgttaataatatgttaaatattagtagttagaatatttatgtatcgttatttttatttttttaatttgagttggttattgatttttagttgtttgtttcgaaatttgttagtattagtagtatttattagtttaataatgtattatgtaaatgataaaataagggtgtaaaattaagtcgaatgttttggaaagatttgattagaaaaaaaagttgttatattagttataaagaggaaagttttaaaagatgggaaaaaggagtataaaatattaggattttttatttgttttatatgtttttaagttttaattttaagtttttaattaataattttagttttgtatatgatgtagtataacggtatagtttattttaaataatgggaacgatagttagtatacgtatatttaaagaaaagttttgagtattatattaaaaaattggtggaaaaaaggattacgttttataatttttgttttaattagtttttattaattgaattattgataattgttttatttaaaaattatattattcgaataatttttatgttttttaaatttattattttaaaattattattaagtatttgtttttttgattgtttaataatttaagttgaatgaaggtgtgttaaaaattaattttaaatatttgtttattaagatttttgttgtttgtattttttattattttgtttaaagttttaatatatttatttaagtttttttgtggtataatataaagtttaaaaaattaaaataatagtgttaagtatggaatttgatgttgttgttaaatattttggttagtttaatataatttaattttcgatttttattgatttaattatttggtcggtatatggataagaaagtaagagtttgtaattgtgtagggaatcggtattaataatgaaaatttgtagttggatatatggttatatagtagtaagttatatataattttaatttttagatttgaatagttaaaggaattattgttataaagtttataattatttatttgtttatggaatatttggtttgaaaatgatgtatggtgatttttataaaatatagtatttggttattttaagtttggaatgttaaatttattgaatgattgaaatgatttttagatattatatgaattgaagttgaataaaacgaatttattattatttatataggatttgagggggggtattataaaggttatagggtaagatattttgtacgttaattttttaatttattaattattatgataatttgattgaatgtttattgattataattttgaaaggataatgttataaaaagtataatacgtatgtagtatgagagttgagatgtatttatttttggagatatttgtttgtgtaaagttgtagatatgtgtggtatagaggtttagggattttgatttttaagtatagattaaatttaagttataggatttattaaggttttattatttaaagtgttaaattttatataaaggttttttatttttaggatttatttattgaaaaaaagtataattgatgtaatatttacgtaagttgttagttaggatatttaaatagtttttttttatagtagtagtttttaatagggtgtagattttgtttttagtggttatttggtaaattttggagatatttttagtagttaaaattaggggaagtaattggtatttagtgggtaggggttaggtatgttgttaaatattttacgttgtatagggtattttttaaaataaataattggttaagaatgttaatagtgttgatgttaagaaatcgtattttagaaagtagagttttttagaattaaattttagtgaggttgggagaatgtagatgttgaaaaattagttgaatgagagtagttattttttgttgttgttttttaaattttaagtatattgtttttttttttttggtttatttattttgttaattttttattttatttttatagtttttttaatttaattttttagttggtttgttttagtttggaattatattatagtttttaaagtaatttttttaggtttttttataagtttgaaaaggggaaaatagtgttgtgggaagagaaggtatgatttttgagaaataattagaaaatatatgtatatagttatatttttgaattgtaaattttttgtttattttggttatattaaaggataatatttgtttggagaatgggaggaggtagaaagtattaagaggtaagaaatgttttatttttatttgatagttgagagattataaaggggtgaagattatagataaaatttgaatttacgaatagaaatatgatattgaatttataagataatttgggtaagggaatagggaaatgaaataaaataatacgaatataatttggggaattcgtttaatgtattttgaagaaaacgtatttatggtagtttttaaggtaagaatagattttttattaaaatttaattatgtaaaagttttaaaatgtaaattaaagataatattattattttatttagatagatttggttagtatagagaagtaggtataaaatttatttgaaaggattttaataaattaaataaattttttttttataagttaattttaattttatacgggtatattgtatattttatagttttataagaaattttagatttataaaatggaaaataaaaattaattttgtaaaatagaaaagtaaagtaattaaaattaataattttaatattacgtttttaaattttaagtatattgtttttttttttttggtttatttattttgatattgaataatttgaaagataatatgttttgagttcgtagatttaaaataggtaattattatttttgaaataaattatatttttttaaaataataaatttttttatttttatttttttttttagttaagtaaaaaaattagttatagtttaaaagataaggatttaattttaagaagtttaaatggggttaatatagtaaatttgaaatttttgtaaattgtttaaatttttaaaattgtattcgtattgtttttagttaagattttgaataatttaaatatttttttaaaagaataaataatggattgtatattttatagtaattaaaaagttttagagatatttttaaagtaagtttaagtaattagttaagatttagtattggattagtatttatatatattattttttatttagtatttttttttttttgtttataaatggattattatatgaattttattggtatagttttttaattttattttttttaatttttgatagtcgagttttaatatagaagtataattttataatttttttataagatgtaattttttgttatttttttaattttattttttataattttttttttatttattttgttttagtattattggtttttttgtttttttgttaatatgataggaattttatagtttttaggtttttgtgtttatggttatttttggattatagtttttttttatatagttatatggttgttattttattttcggtaagtttttgtttaaatgttatttatatcgaagttttttttaattaatttatataaaatagtaattttttttttatagaaattttttttttttttatttggtattattttatagcgtttgttattatatgatatattatattttatttgattgttttttttttattttagaggggaggttttatttttatattgtttattgttgtatggtaagtaattaggatagagtttggtattgttaagtatttgttgaataaatgattttatatatatatatatatatatatatatatatatatatgtattattttttatatgtttgtttttatatatatagtatataattatatgtaaaatatatattagagtatatatttatataaaatttataataaataaatttatataatatataaatataaatttataatatataaatataaatttatataatatataaatatatataatatattttattatagtttatatatatatatatattttatatatagagagttaagtatacggaaagttagggtagtgattgatagtagttgataattgtttagaaatgtttagatgtatttatttaattttgattgtaataatttttattttattttaaaatagttttttataatttttaagtttttaagatttattttttaaaaaatagatttttaattaaaaggaaagtatttaaaataatttgatttagattattgtgtagggtaaattttagcgatcgttatttaaattgtggtaattgataaaaattttagatttgttgtattattaaatatgaattgtatttgttttttttatattaaaatattaattataaaaatttttgtttaatgaatgttttgttttatttgttttatttattttgaggttttcgcggtaagatttaaatggatagtgatttggttgttagttggtgttaaaaataagttaattttaagaaagttatgtaagttttttaataattaaagtaaaagttatttttttatatattagtattttaattttttaggatgttttataatgatattttttttttttttagggattatttttaagtgagaaaaaggaagtattagaataataaagaaaagaataaaagatttaagttttttagtttttaagtaatgatttgagaagtatattagtttttgattagttaattataaagtatatgaaaattgtattatcggcgggcgtagtagtttatatttgtaatttcggtattttggaaggtcgaggcgggtggattatttgagtttaggagtttaagattagtttgggtaacgtggcgaaatttcgtttttataaaaaatataaaaataaaaaaaaaattagtcgggcgtggtggttcgcgtttgtggttttagttatttaggaggttgaggtgggaggattatttgagtttgagaggcggaggttgtagtaagtcgagatcgcgttattgtattttagtttgataaagaatgatatttcgttttagaaaaaaaaaaaaaagggagggaattgtattttttgtgttttgtatagaggttatataagaaatttcgtgttagaaattaaagtacgtagtatagttatttaatttatatttgtgtagtgaagagagtttcggattggattcgtttttgttggtgtttgggaattgatagttgtttttttattttagttatgtttagtttttagatttttaggtgttagatagaaagttggattagaatatttttttaagttattttttcgtagaaatttggtgttttattattaaaattaaatgtatgcgattttgtttttattttaattgttataatatttaaggagagataaacgttagtagataaaatttatttaatttaaaatgtttgttatgggttttttttttatattgatagtatttgttaacgtttatcgttttttaagcgttggtaaatgataaaatattattgttgttgatgtgtattattttatttaatttttataaaaattagaagatataaatattattatttttgtattatagattaaagtttaaggagattttataatttggataagattattaagtaaatggtagggtttggttttgaatttaaattttttggttttaaagttttattttttaattattattatatattttttttaaaaaataatatattaaaatgttaataatagaattattttaagttttatttttttggtgtgtggatttgtgtttttgatcgattgtaaggtttatgtgtaatataagtattttttttttgttgttgttaaaattagaattattttatttttatgaaggtaatattgatttttacgagtataattatttaaacggagatgggaatttttgttttaatttttttagaggtttgaagttagttttttagtatttttttttatataagggaaatgcgtttacggttagtttaaaatttgtagtaatttgtgtttgtttattagggattttttgggcgtaggtaagataatattttttttttgtagtttgaaagaagtgaaattaacggataattattatcggaatagagtttagattgtaatttatgagattttttagtttttttttttagtgaattttttcgagttttttttaggtgtagttttgaaggttaaaacgagatattaggattagtgggtttttaagaggcggtagtatagatataggtgtgtttttttgtttcgtggttttacggacgaaattttgaagtatttttagagattaagggtttatttatggggtttattaggttttttttttcgaggatcggtttttgatttaaagaattggggcgggggagaagtcgttttttagaagtcgttcgattatatcgttattatattttttttttttttttcgcggtttttcgtacgttttcggggagaagagtttttagtttttttcgtggatatttaaagacgtcgagtttcggtttttaatcgggagcggttttcgtggtcgggtcgtaggtatttatcgtcgttttcgtcgttgtgtcgtcgtcgcgatatgttgtttttcggtgcgtcgcggaatcgagaggttaggcggtaagcgttgtaggaattgtttggtcgttggtcgacgtaaggatagttgtaaggcgcgcggatgggtcggtacgtaggcgtattagttcgttacggtttcggaagcgtaggagaggtcgtcgggtggggttaggcgttgcgatagtcggcgtgaggaagtttagtgggttacgaacgtttggtatatatgtaatcgttttttcgggttgttttcgtttgtcggttatttttttttttcgtttttcgttttatgttttttcggggttacgtagaaagtgtcgtcgttttggttatttagagttttcgggtcgcggtcgtcgtacgtttgaaggcgggtcgtgtcggcggtcgttttagttttcgttttcgtttaggtcggtttttcggggttttttaatggtttttcggtggttttttaatggttttttcggcggtttttgcgtcgacgttaggagattttcggagtttggtgacgttacgagcgagtttttttatttaaatacgcggcgggggaataggttcgagggcggtgagtagtgataattgttaggcggagatagtgtagggaagagagattttagaaaggattaggattggcgggtatgtgtttatttatttttatttttcggtttttgtcgttttgggaaaagtgagagaanaggttgggttaagttcggtatgcggggtggggtttgggcgggaggcggtgtcgtacgtttcgttttttggtatggaaagtcgggttttgacgcgagcgtgcggtttcgggtttgtcgattggtcgttattttttttaagttgtttgtttaggaaggaataaatgattgttttagtaatttgtttttaagggttattgggtatttatatgtttgtgtgtgagcgtttttttttttgatgtttttatgagtattatattggtttatttgttttgtttatggttatttgaaattttattttttcggtttaattttttttcggttttatttattttagtaaatgacgttattcgtcggtcgtttaatttaaaaatttagagttttttttagtttttttttttttttttatataataattatttgtaaattttgtttgttttgtttttaatataaatttagaattagatcgtgttattgttttgtttaaaagttttttatgacggtcgggcggggtagttaacgtttgtaattttaatatttatgggaggtcgacgcgggcggattcgtttgagtttaggagtttaagatttatttgggtaataaggcgaatatcgtttttataggaaaaaaaaaaaaattagttgagtttagtgtttggcgtttgtagttttagttattcgaggggagggttgggggtcgaggtgggaggattttttgagtttaggaggtcgagaatgtagtgagcggtgatcgtatattgtattttagtttgggtaataaagtgagatcgtgttaaaaaaaaaaagttttttacgattttttattgtatattttatgttatggtttgtggggttttatttttttttattgtattttaattattttttttgtttttataataagttaagtttgtttttattttaggaatttatattattttttttatttgaaggtttttggttttaaatttgcgtggttggtttttggttatttaggttttagtttaaatgttaggtttttagtgaggttttttttggttatttaattattgttttattttatttaacgaatattatatttattagtatttagtattttttaggtgttaggtagagttttgaatgttgaggatgtagaggtgaataaaggaaaatttttgtttttttggcgttgatatattttaacgatttatttaggaatatttataaatagtgttattataggtagtgagtaacgggagagtggtagatgagattagagaggtagggggaaggtgttttgtgaggattttggatattatttaagtgaattgagaagttattggagtatgattttttttttttgagatagggtttcgttttgttgtttaggttggagtgtagtggtacggttttggttcgttgtaatttttgttttttaggtttaggtaatttttgtgttttagttatttaagtagcggtaattatagatatgcgttattatattaggttaatttgtatatttttagtagagatggggtttcgttatgttggttaggttggttttgaatttttggttttttaaagtgttaagattataggtataagtttttgtgtagggttagtttgatttattttataaatagttattttttatgtttttaaaggaggaagatagttttagggttatttgttatgtaattattttagaatttttagtgtttatttttggttgttttttttaatattgttttgaagagaattaattttggttagtttattagtaatataaaataattagttgttatgttgtggggtaggaatttgaatagggtataatagggatattttgtttttgtttttagtttagaggttaatttggaatttgaagggtttagtggttgatgttggttgttagttggaggtttttgtttttttttatttggttttttgtgtgtggtttttgtatgggttggattggtttatttataatatagtggtttggtttttttagcgtgagtattttagaatgagagtttgtattagcgtatttttttgagaatttaattttagttatatagtattgtttttattacgttttatttttgggagtagttaataagtttgtttaggtttagggaaatggattagaaatattgttgtagttatttttggaaaatataatttgttatagttaatttttaaataaaattttaatgttaaatttaaaatatagtatttaattaaaatattaataatattattatttattgaattttagtttgtgttagatattatatattaatatttttttttagtttatagtatagtattgtaatgtagatattataatgtataatttttataagagagatttagaatttagaaattttaagtagtttgtttatgtttatatgtttggtaaattgttgtagtataaattaaagtttatatttttttttagtgtgttttttagtgtttgttatttgttatttttgttttataaaagaattaatatggtatgatggttgtagtgtgtttattttgataagatttggttatagtagcgattttgatattttttttggtatattatagtggggttgttttgggaattattttttttaaggaaggaaatttttatagttttgaaattaaggggtaaaaagaagaaagtgtttataattgaaggtgttggtatatattttgattgatttgggttgtatttgttgtttttttgggtattatttattttaatgattgtatggttcgttttttaatttagggtttttgtttaaatgttattgttgtagaaaggttttttttattttttgtgtcgaaagggtttttttattattgtttttttattttgttgattattttttataatttttatattatttgattttaaaaataaaaaattaatttatttatttgtttattttattttattggaatgtaaattttaagtaggtagaaatttttttattttcgtttattgttatatttttagtgtttagaatagtgtttgatttcgagtcgtttttaagtaaatattattgatttagtaagtaaatggatggttagtttgggttattttgtttatgttgatttgcgtgattgattagttttatattttttttaagaaattaaagaatagtatggttgttttttttttatttatattttaggaggtatttaattgaaaggaatatttgttttattgttgtaattaaattagatgtttttttttattttattagattaaggagatgatttggagaattgtattttaagattttttgatttggatttaaaagatatgagttttattaattttagtagtagttttaaagtagaattagatggtagtataaaaaagaaatattcgtttgtaaagaaaaaggtagaatttttatgaatgttttatgattatgtatgtgtggttaacgtagatatatttggaagtcggttattaaggttgttttttagtttaaggtaaagtttagttaggaatattaattagtgatgttaattttattttaggtaaagggtaattataggtaaggtgtggttttggaatagttatggtggagtatttgaggagggtggattttagatagatggattagattttattttttattttttaggttaaaaaagattataaataaagttgaaaattaaatgataagtgaagaaaaaagttggtaattatgattaataaaagattattaaaaatacgtattagtaagaagataaatgttataatggaaaaataggtaatagatttgaataggtaagttagaaataaataaatagattaagtaggaaaaagtatttagtattattattaattaaaaatattaaaaaaaaaaatagggtagtattttttttgttttttatttggattaatattaaaaatattgatgataaaaaatattgatagaatttagtgaggttatggataaaatggtatttatatgtttttttggttagagtataaattggtatattttttttggaagttattattatagattaaaattttatgttttttgattttttaatttttattttagatattttaagtaggtggttaaagatatagaaagatagatgtatggaatgtttatttaatatggtttttaattgtaaatattagaaataatttaaatgtttattagttggtaattggttaagagaattttttgtttgattgttttataataagtataagtaatttttataaaaatag

SEQ ID NO: 103 - DNA, 15649 bp, Artificial Sequence
  chemically treated genomic DNA (Homo sapiens)
tttgatggtatttattagttatgtgagtatgggaaaataattttatgtttttaagttttgttttttttatttataaaatgcgaataataaaaatattttttttagaagaatgaaatgagataatttattgtgttatgtatagagtaattatatatcgttttaattttttttttttttttttttttttttttgttttgagatttagtagttgaagatagaagtgaaagattttttttgtaggtttgaatataaatttttattttttttatatttagttataaagggttgtagttatagtttttttacgatatttttattagaaataaattagattaaggtttggtttagtggtttacgtttataattttagtattttgggaggtcgagatgtgtagattggttttgtttgtttgtttgtttgtttgtttttaattttgagatggagtttcgttttattatttaggttagagtgtagtggcgagattttagtttattgtaagtttcgtttttcgggtttacgttatttttttgttttagtttttcgagtagttgggattataggcgtttattattgcgttcggttaattttttgtatttttagtagagacggggttttatcgtgttagttaggatggttttaattttttgatttcgtgattcgttcgtttcggttttttaaagtgttgggattataggcgtgagttatcgtattcggttcgagatgggtagattatttaaggttaggagtttgagattagtttggttaatatggtgaaatttcgtttttattaaaaatataaaaattatttggttatggtggtatgtatttgtaattttagttatttgggaggttgaggtaggagaattatttgagtttaggaggtggaggttgtagttagttgagattatattattgtattttagtttgggtgatagagtaagattttattttaataaataaataaataattatataaatatataaattagattagtttgggtatggtggtttatgtttataattttagtattttgggaggttgaggtaggaggattatttgagtttaagagttcgagattagtttgggtaatatagtgagattttatttttatttaaaaaaaaaaaaaataaataaataaaaaaaaaaaaataggtgtagtggtttatatttgtaatattagttagtattttgggatgttaaggcgggcggattatttgaggttaggagtttaagattagtttggttaatatggtgaaattttgtttttattaaaaatataaaaattagtttggcgtggtggtgggtatttgtaattttagttatttgggaggttgaggtaggagaattgtttgaatttaggaggtagaggatgtagtgagttgagattatgttattgtattttagtttgggtaatagagggagatttcgtgaaagaaaaagagatagagagagggagagagagagaaaaattagattaattgttttattttgtgttattgaatttaggtgttgaaaatattaataaaataatttgttgataaaataaagtttagtttatttttattgtagtgagaagagtattattttgatagagttgtggaggtttaaagtagggagtatatagtggtatatattgagtttttgaaatttggtttaagtgtaggtttttttaatgcgggttgggggttgattaggatggggtaaggattatgatataattatttaggattggtagatataatagagtattttgaggttagcggttgtataaatatttaacgagtttttgtttattgtttagagagagttaatttattaagacggggaattgtaatagggaaagagtttaatatttatagagttagttaaatgagagagtagaattttattattatttaaattagtttttttgaaaatttggaggttgggttttttaaagatagtttggtaggtagggggttagggaatggatgttgttaattggttggggatgtaattataggggtatggaaaatattttttgtgtgttaagtttgtttttgggtggggagttataggattagttaagagttttgggttttggtggagttatttgattgttagaaatgttaaagtttgaaaggatttattaagaggttaattttaggttttataatagtgatgttatttatgggagtaattgggaaagttgtaaattttgtgatttttagaataatggttggtaattatttaattatgttaatacgttagtagaatttaggttttttttataattttaaatttgtggttttttattagttttataaaggtaagtttggtttttttttatttttttttttttgagataaggtttcgttttgttgttaaggttcgagtgtagtgtgtaattattgtttattgtaaatttaaatttttgggtttaagtgatttttttgttttatttttttgagtggatgggattataggttggagtgtaaaggtgtaatttcggtttattgtaattttcgtaattttggtttattgtaatttttgttttttgggtttaagcgatttttttgttttatttttttaagtagttgggattataggcgtttgttattatgtttagttaatttttgtatttttagtagagattgggttttattatgttggttaggttggttttaaatttttgattttatgattcgttcgtttcggttttttaaagtgttgggattataggcgtgagtcgttatgttcggttagtttttatttttaatttattgaaatagttattatgttaatgtagataataagttgtgtgggtgtagatggtttttatttttagtgtttttagaaaatttaataagtaaaattaagggaaatgtatttaggatattgagggtatttgtttttgtagatcgagtttaaaatggaagatattattttggtaatttagaaggtgatttgaattttagacggatgatttattttttggtttatttattattttttattatttgtttattttagttgaatgttattagttttgtgaggaagtagattaggaatgtttattttcgttgggtgtggtggtttatgtttgtaattttagtattttggaaggttgaggttggtggattataaggttaggaatttaagattagtttggttaatatggtgaaatttcgtttttattgaaaatataaaaattagtcgggcgtggtggcgggcgtttgtagttttagttatttaggaggttgaggtaggagaattatttgaattcgggaggtggaggttgtagtgagtttagattatgttattgtattttagtttaggcgatagggtaagattttgtttcgataaaaaaaaaaaaaaaaaaggaatgtttatttttttgtttgagatggtatagaaaaatttttttttatatttaaatagtggaagaaggggtatttttaaatttaattttttatagatagtatatatagtatttaatattttttggatgttaaagaaaaaaatattttgaaatttgttaaaatggtaaggaagaatttatttaggattaaaggggagattatgttgtattttgaatataataatgataagtgggatttatagttaataagtagagtgaggggttattgtatggaaaattattaaaaggagatttttgttaaattaatttaataggatttttgttgaaggtaggttagggttattagatattaaggatgggggattttttttaaattgatttagtagaattttttttttattgagtttattttttttttttttttttttttttttttttttgagatagggtttcgttttgttttttagattggagtgtagtggtgtgattatggtttatggtagtttttattttttaggtttaagtgattttattattttagttttttgagtagttgggattataggggtttatcgttatattcggttaatttttttattttttgtggagatagggtttttttattttgtttaggatgatttgaaatttttgggtttaagagattttttatttcggttatttaaaatgttgggattataggcgtgagttattgtgtttggttatgagtttatttttttttttttttttgagacggagtttaaggttagtttggttaatatggtgaaatttcgtttttattaaaaatataaaaaaatgagtcgggtatggtggcgggtgtttgtaattttagttattggggaggttgaggtacgagaatagtttgaatttaggaggtagaggttgtattgagtcgagatcgtttcgttgtatattagtttgggtaatagagtgagattttgttttaaaaaaaataaagatttttcgtgaagtagtgttaagtggatttaggagaaaaatgaagatgattttttaatggttttttaaatgtataaagtttttttatttagggaagaaagatataaagatgtagtttaggcgcgatgatttaggtttgtaattttaatattttgggaggtcgaggtagttggattttttgagtttaggagtttaagattagtttaggtaatatggtaaaattttatttttattaaaaatataaaaattagtttggcgtggtggcgggcgtcgtatgggtattatggttgttttagttatttaggaggttgaagtgggaggattatttgagttcgggaggtcggggttgtagtaagtcgtgttcgtattatggtattttagtttggacgatagaaaaagaaaaaagaaataaaggtataaaagaaaaaaaagaaaagtaaatagttttttttaggggatgaagtaggtttatttcggtgagattgttgtttagaatttaggagagttattaaaggtagaagatcgtttttggggttcggttatttgaatattataagttttagtaagcgtcgcgcgggggcggggtttgttgatcgttgtgacgtgtgggcggggtaggcgggtcgggtttttttttgggtgtttagtttcgttttcgttttattttgttttgttgttgtcgcgtcgttgttggttgttgtttttggtgagtgttttaagtggaaaggggtagttaggttttcggggtgtttatatttagatttgtagttttgagaaggggttacgggggtagaggtgtggtaagtttcggtttttatcgtagtttattttttggggtgatagtgggagtggtgttttgaaggttttggagtttttttcgcggttcgggagggttgcggggtagttttgttttgcggagggtagcgttgtagtgttgtgtggtagggtgggaggtttttcgggaagaagtgatatttttggcggcggcgagggttttgaggcggcggttgtcgttttacgggtcgtggcgtttcgttttttttcgcgggtttaggttgtggtggtttcgtaatttttcgtttggatgttatcgtcgttggtttcgaggcggaggtggagttttgttgcgttattttgagtaagttattttttttttgggttttagtgtttttttttacgagtaggtttgatttttgaagcgttttgttttttgtatgttgtagttgtcggagaagacgttttaggtaggaggaaagacggtgtcgtgatttgtttttatagttaatttattgtttttttattattgatttagtttagtttgggagttaatgtttttattcgtatattattttaattttattggacgtgttaatttttttttattatttggatttttgttttatatgtaagttaataagtgattatggttggagttgagtaaaatatggataatataatttattttattattggaaatattattgtaagtaaaggattttatgtggtaggtttttgtagtttgtggagaatatatgattaaggaatatttagatggtttagttttttaggtatttttaagggatttggaaattttattttttggtagatatgatagttgtggaatggaaagggttttgaaaaaggtagtcgataattttgagttatttggtattaataggttatattgtttttcgagttagatagtatatttgtggttttttaaaaatttaatttggttgattaggcgcggtggtttacgtttgtaattttagtattttgggaggtttaggcgggtagaattatttgaggttaggagtttaagattagtttggtaaatatagtaaaacgttgtttttattaaaaatataaaaattagtggagcgtggtggcgggcgtttgtaattttagttatttgggaggttgaggtaggagaatcgtttggatttagatagcggagggtgcggtgagtcgagatggcgttattgtattttagtttgggtaatagagtgagatttcgttttaaaaaataaataaataaaaatttaatttggtagtatgtattgatagaatgttatgtatttttaattatttttagatgaaaagagagttaaatgaatttttttatttttttttttttttatttaggattattattatattaggtaaggtttttgaagattttttagttttagttatgtattttgttgatgaggaaataggttagaaaagggtattgtgatttggttaagtttttagagtggtagaattaagataggaatttagtttttttggttgttagtttagttttttttttattatattttaaatattgttattgtttatgttatagggatatggtatgttagaattatttttgttaagggaaaagtggatggttttagtaaaatggagattagtatatagttttgagttttttagagtttttagttgttcgtatttgatgttttagaattattttttttatttttttttagaattggcgttagtattatggtggtgtggatgtgagatgagggtttgtttagaaaaagttggatagtaaatttaaataattgttaatgagtagtaataaaggttttttggggtgtaaaatttttgtaagatattttgaaatatttttatattttaggtaagggtttagaattaatttggaaattttgggttagagtaaatggttcgataatttgaagattagtgattgtgtttttgtttttgttatttgttttagggttatttatatatatttatagtatttattgttggtattttttaaggttggttatgtgtaagtatttttgttatggttagggagaaacgggatttaaattaatttatttatttttgttaattgttaatcgtttagaaagaaaagtaagtagaaggtcgggtatagtggtttacgtttgtaattttagtattttgggaggttaaggtgggtggattacgaggttaggagttagagattaatttggttaatatagtgaaatttcgtttttattaaaaatataaaaattaatcggatatggtggtatatgtatgtagttttgggaggttgaggtaggagaattatttgaatttaggagatagaggttgtggtgagttgagattatattattgtattttattttgggtaatagagagagattttgttttaaaaaaaaaaaaaagaaagaaaaaaagtaagtagaaagataaaggaatttaattaaattgggtttgatttttatttttgtttttattgtttttaaatgaagaattgatttgtatgttttttttgtttgtagaagtatttgatttttttttgtgaattaatttgtagtttttattttttttgaaatatatgtttattggtataaaaaaggttaatgtaaatatgttggttatttaaaaaattttttgttaaaaaatttattagtgtagtttgtagatgtagttagaaagagtagaagtaggttgggtacggtagtttatgtatgtaattttagtattttgggaggtcgaggtagatggatcgtttgagtttaggagtttaagattagtttgggtaatatggtgaaattttgtttttataaaaatataaaaattagttaggtatatgtttagggttttagttattttaattgaggtgagaggattgtttgagttagggatgttaaggttgtagtgagttatatttatgttattgtattttagtttgtaagattttatgttaaaaaaaaaaaaaaaaaaaaagtaagagtagaagtagaataggttgttgttttttttttttaggaagatataagaggatttatgtttttatggaatagttttgggagtagtatattaggtttgaaaagtttattagatgaagatgtgttaggtttttttggaagttaggagatagtttaggggatttatttaaaaatatttttttattattgtttgtttttttgagggttttaatttttttggaaattgagttgaaaaaaggtaatgattatgttagaggttaaataaagttgtttttgatagtttgtggaatttgtgtattattttatttatgtttgatagttttgtttttgaaaatttttatttgttttttttgtttattttttatgtggttaatttttgatttgagggttggaataaggaattaggtaaaatattattttataatttttaggggatttagttcgttttattaattttttataatttagtagttttttgggtttttaaatttaatttttgtttttatatttttttttttttttttatttttatgaattgttgttaagttagaaatggatggtagataggttttatagtgggaaaggtggttaaaggaggggaagttgatgtttaagttattttaatttttatgggttaggtgtagtgatttacgtttgtaattttagtattttgggaggttaatgcgggaggattgtttgagtttaggaatttaagattagtttgggtaatatagggagattttatttttataaaaatataaatattaggtgggtatggtggcgtatatttatagttttagttatttgggaggttgaggtggagggttatttgagtttgggaggttgaggttgtagtgagttatggttgtgttattgtattttagtttgggtgatagagtgagattttgtttttttcgtaaaaaaaataattttttttatatatttttttttttttgtttataaatatttatttttagattattttgttagaaaggtaattttttaagttattgttggagtttattttttttaggaattttattattgggaggaagggaagattaaagattattgatttgaaaatttagtagatgttttttttttaggaaaagttggaatatttttttattgattaagttcgggttggtatggttatgttttagtttatttatggttttttgtgtttatagtttggtaaaaaggagagaagagaagttattgttgtttttatttatttgtttttttaaatttttttttagttttggtagaggagaattttaattttattttaagaatgattgagtttttaatattttatatgttattggatgttttttgagttttttttgggaaggtgatgagatttttgaaatgggaaattttatggggttttttgtatttttgataagtaaggaattaaagttgtttatttttttagatagattattaggtttttaggtgaatgaaaatagttagaattttttttgattatatatttaagttttagaatatgagttttttcgtgttgtttatatatgtgttgtttttttttaagcgttttgtttatgagttaatttagattggttgtttttttttttttttttttttttttttttttttttgagatagagttttttgtttttgttgtttaggttggagtgtaatggtataatttcggtttattgtaattttcgttttttgggtttaagcgatttttttgttttagttttttgagtagtttggattataggcgtttattattacgttcggttaattttttgtatttttagtagagatagggttttattatgttggttaggttggtttcgaattttttattttaagtgatttatttattttagttttttaaagttttgggattataggtgtgagttacggtatacggttagattggttgtttttttggtaatgaaagagaaattatattaagttattttatgtttttagttggttttgttttttagagtagtatttatttttataatagtttgttagagtttgagtgtgtgtaaggtaggtaatggagtgtgaatttgatgggtttttaaggaaattaaatttgttttttttggttttttggtattatgttatttgaattagttatgttagttgaattagttatattaagaagtgatttagtatttggagattattatttttttattttattttagaaaagagaaagttgagaaatagtagtttttttaagggttaataataaattaagagggtttaaaaaaataaaatatatatatttttagttttagagttatttttattattgtttatttataaagttttttttttttttattttttgatgaatgatgtgtatattttgttagtttatttatttaataaatatttaattagtgattattatattttaggtattgtgttatgtatataatggtgatagtgttgtgaaggaaaagaaatggggataaggtatttggtatttgtgtataatgagggttttttttggatgttatgggagaatgggtagggaggttttttagtttgtagattttttatttttaagtggtttattgatatatggaggttagcgtatgaggggtagtttcggaagttatttttttttttttttttttttttggagatagagttttgtttttattgtttaagttggagtgtagtggtgcgattttagtttattgtaattttcgttttttaggtttaagttattttgttttagttttttgagtagttggaattatagatgtatgttattatatttagttaattttttgtatttttagtagaaatggggttttattatgttagttagtttgtttttgaatttttgattttaggtgatttgtttgttttggttttttagtgttgggattataggtatgagttattatacgtagtatttagaagaatatttagaatatttttatttgagtgttttttatgattcgtaaaggataagttaagtaattttatacgtatagataaattggtgttttaggtttaggatagagggatatgttggtttttatatgacggtagattatttggaaataaagggtttgtaagttgagaaatttttttgtttatttttttatagtatttaagagaaatttttattgtatataggtaatagtttattatagggaaaaattttgatttagattggaatgtgaatatttttttatcgttgaaaaatttttttgagtcgggtatggtggtttatgtttgtaattttagtattttgggaggttgaggtgggtggattatttgaggttaggagtttaagattagtttggttaatatggtgaaattttttttgtattaaaaatataaaaaattagttgggtatggtggcgtgtatttgtagttttagttatttaggaggttgaagtaggagaattgtttgaattttagaggcggaggttgtagtgagttgagatatcgttattgtattttagtttggggaatagagcgaaattttgtttaaaaaaaaaaaatggaaagaaaaatttttgaggtttgaggttgaggatgtggttaaattgtgttataaattagaaagttaatgtattttttagttttttaatttaattttaagaatagatagtttagtgttttaaagttttgttgttttttttatgaaaaaattgatttttggggagttggaagagtaggtttggttgtttagattttaaagtaaaattagtaaatagataggatggggttagaataagtattatggttgtttgggaggttttgtttttttggttattgtatttatttatttttaaaaattatatgtgtgttagtcgggcgcggtggtttatattgaagtaggaagagttatagataaaattttttagatatcgagttaacgaaggatggggtttattaggtcgggggtattagtaagatttttgttttaagagttgagtttttcgagtgagtaatttttgttttttttaagggttaataattttaagggggtacgcgtgagagggtcgtgattaattgagtaagtagggggtatatgattgggggttgtatgtgtcggtaattagatcgttataaaataggatagggatttttatagtgtttttttatataatgtttgtaatttatagataatataattaattaggttaggggtcgatttttaattattaggtttagggtgtggcgtcgggttgtttgtttgtggattttatttttgttttttagtttttattttttttttttttggagatagaaattgggtataagataatatgaggggtggtttttttttttaatgtttgtaattttagtattttgggaggtcgaggtgggtttattacgaggttaggagatcgagattattttttttaatacggtgaaattttgtgtttattaaaaatttaaaaaattggtcgggtatggtggtaggcgtttgtagtgttagttattcgggaggtcgaggtaggagaatggtatgaatttgggaggtagaggttgtagtgagtcgagatcgcgttattgtattttagtttgggggataaagcgagattttgttttaaaaaatatatatatatataataattatatgtgtgtttgtatgtgtatataattttttagtatatattaatagttgaatttgtaagatattatatagtatttgtatgtgtatagttttttttttattttttgtgtataattgaaatattttttttatgttttagtaaaattttaaattgagaattacggatttattaaatgttagattagttagttatttagaaaatagtgtatgtgatttgtttaaggggtaggaagtattaggtgttaataattaaaattattttgttttttttttttttttgagacggagttttattttgtgttttaggttggagtgtagtggcgtaatttggtaattttggtttattgtaaattcggtttttcgggtttttgttatttttttgttttagttttttgagtagttgggattataggtattcgttattacgttcggttaattttttgtgtttttagtagagacggggttttattatgttagttaggatggttttaattttttgatattatgatttatttatttttgttttttaaagtgttgggattataggtatgagttattgtgttcggtttattttgttttttttatgtattgtttttgattttaaaatggtttttttttttttttttttttttgatagttttattttgttttttaggttggagtgtagtggtatgattttggtttattgtaatttttgttttttgggtttaagcggtttttttgttttagttttttgagtagttgggattataggtgtttgttatcgtgttcgggtaattttcgtatttttagtagagatagggttttataatgttggttagattggtttcgaatttttgattttaggtgatttatttgttttagttttttaaagtgttgagattataggtgtaagttatagtgttcggttttttttttttgttttgttttgtttttttttttttttttttttttttagacggagttttattttttttgtttaggttagagtgtagtggtatgattttggtttattgagattttcgtttttaggtttaagtaatttttttgttttagttttttaagtagttgggattgtaggtatgtgttattacgtttagttaattttgtatttttagtagagatggggtttttttattttggttaagttggtttcgaatttttaattttaggtgatttatttgttttagttttttaaagtgttgggattataggtgtgagttattatgtttggttttttttgtttgtttgttttaatagagatagttttattatattgtttaggttggatttgaatttttggtttaagtaatttttttattttagttttttgaatagttaggattataggtatgtattattttagttttttatttcgttgttgttgttgttgttattgttattgttttgaggtaggggtttgttttgttgtttaggttggggtgtagtggtataattttggttcgttgtagtttagattttttaggtttaagttatttttttattttagtttttcgagtagttgggattgtaggtgagtattattacgtttagttaatttttgtagttttttgtagagatggggttttgttatgttgtttaggttggttatgaatttttggatttaaaagatttattcgtttttgttttttaaagtgttgggattataggtgtgagttattgcgtttagttataatttttttatttttgattatattttatttgtattataatttagaaaggtgaaatatagtgtattatttttatttatagttagggatttaaatttgtttgttgttttttaaatgtgggttgtatttttttgtttttttgttgttatttatgttgttttttttatttagaatgtttttatttaaaaatttatttgtcgaaattttaattttttttgagggttaatttaagattttttttattttttgaagttttttttatttttttaattagttgtatttttttttgttttgaattcgagagtattttgtattttttattcgatttatttggtagttatttgtatatttttttattttttttattggattgggattttttttaaggttgtattaggaaaaaaaaatttacgattataatagtaataattatataattaattataattaacgttttttaaattttttatgtagattttgtgttaagtattttgttatttaatatgtattaattttgtgtgaagtgtttataatggtagatattgatttaagggttggatattttatattattttatttatgttttataaaaaattaaatggggtagatgttatttttagttttaatttatagataaggaaataggtatagagttagtagattatataaattgtttaatgttataaatttaataggtggtgaagttggaatttgaacgttattattttaatttagaatttatgtttgttattattgtatgttaaataatttttttttatttttatttttaggttttagtagagtattttatgtatggaaggttttgataattataggataaatgggattgaatatagaagatgaaatttagagagatggatttttttaaagttatagggtttgttgggatgaaaaatttagaatttaatagtttttagtttaggttattttatttaggttgttttgtttatttaagttatttggagaaaggggaattaaagtagttataagtttttgtttatgtgagggttgtggtgtttgtggtgaagaagttaaagatattgttagaaaattttcgtagtataggaagttgtgattgagatggttcgaagtgaaatagaaagtaagttgtgtaattttagtatttgttaggattttgttttttttgatttgttttgtatagaatgttttttggatgaaagtttagaaattattaatattttagataatgttttttgagttttattttgttttatattttataatagg

SEQ ID NO: 104 - DNA, 15649 bp, Artificial Sequence
  chemically treated genomic DNA (Homo sapiens)
tttgttatgaaatgtggaatagagtaaggtttagaaagtattgtttgaaatgttggtgatttttgggtttttatttagggaatattttgtgtaaagtaagttaggaaaagtaaaattttgataaatattgagattatataatttgttttttgttttatttcgagttattttagttataattttttatgttacgagaattttttgataatatttttaatttttttattataggtattataatttttatatgaatagaggtttatagttattttagtttttttttttttaaatgatttaaataagtaaggtagtttagataaaatagtttgagttgggaattgttaaattttagattttttattttaataagttttatgattttaggaaagtttatttttttggattttattttttatatttaattttatttattttataattattaggattttttatatataagatattttgttaggatttggggatgggaatgagagaaaattatttgatatgtagtagtgataagtatgggttttaaattagaatggtggcgtttaaattttagttttattatttattaaatttgtggtattgggtaatttatataatttgttggttttgtgtttgtttttttatttgtaaattggggttaaaaataatatttattttatttagttttttgtgaggtataagtgaaataatgtaagatgtttagtttttaaattagtgtttgttattgtaggtattttatataaagttgatgtatgttgaatgataaagtatttagtatagagtttgtataaagggtttaagagacgttagttatagttagttatatagttattattgttgtagtcgtgggttttttttttttggtataattttaaaaagggttttaatttaatagagaggatagaggagtatataaatgattgttaaatgaatcgaataagaagtgtaaaatgttttcgggtttaaaatagggagagatgtaattggttaggaaaataaagaaaattttaaggaatgagaagaattttagattagtttttaaagaggattaggatttcgataagtgagtttttgagtgagggtattttaggtgaaggaaatagtatgagtaataataaagaaatagaaaaatgtaatttatatttggaagatagtaaataagtttggatttttagttataaatggggataatatattgtgttttatttttttaggttatagtatagataaaatgtgattaagaataggaaagttgtggttgggcgtagtggtttatatttgtaattttagtattttggaaggtagaggcgggtggattttttgagtttaggagtttatgattaatttgggtaatatggtaaaattttatttttatagaaaattataaaaattagttgggcgtggtggtgtttatttgtagttttagttattcgggaagttgagatgggaagatggtttgagtttgggaggtttaggttgtagcgagttaagattgtgttattgtattttagtttgggtaatagagtaagtttttgttttaaaataataataatgataataataataataacgaaataggaaattagggtagtgtatgtttgtagttttagttgtttaggaggttgaggtgagaggattgtttgagttaggagtttaagtttagtttgggtaatatagtgagattgtttttattaaaataaataagtaaaaaaagttaggtatggtggtttatatttgtaattttagtattttgggaagttgaggtaggtggattatttgaggttaggaattcgagattagtttgattaagatggagaaattttatttttattaaaaatataaaattagttgggcgtggtggtatatgtttgtaattttagttatttgggaggttgaggtaggaaaattgtttgaatttgggagcggaggttttagtgagttaagattatgttattgtattttagtttgggtaagaagagtgaaatttcgtttaaaaaaaaaaaaaaaaaaaaaaaagtaaagtaaagtaaagaaaaaaggtcgggtattgtggtttatatttgtaattttaatattttgggaggttgaggtaggtggattatttgaggttaggagttcgagattaatttggttaatattgtgaaattttgtttttattaaaaatacgaaaattattcgggtacgatggtaggtatttgtaattttagttatttaggaggttgaggtaggagaatcgtttgaatttaggaggtagaggttgtagtgagttaagattatgttattgtattttagtttgggggatagagtgagattgttaaaaaaaaaaaaaaaaagagaaattattttggagttaaaaatagtatataaaggaaataaagtgggtcgggtatagtggtttatgtttgtaattttagtattttgggaggtagaggtgggtggattatgatgttaggagattgagattattttggttaatatggtgaaatttcgtttttattaaaaatataaaaaattagtcgggcgtggtggcgggtgtttgtagttttagttatttaggaggttgaggtaggagaatggtaggaattcgggaggtcgagtttgtagtgagttaagattgttagattgcgttattgtattttagtttgggatatagagtgagatttcgttttaaaaaaaaaaaagaaataaagtgattttaattgttgatatttaatattttttgttttttaaataaattatatgtattgttttttaaatgattagttggtttaatatttagtgagttcgtaatttttaatttagggttttattaggatatgaaaaaaatattttagttgtatatagaagatgaagaaagagttatatatatgtaaatattatataatattttataaatttagttattggtatatgttggaagattgtgtatatatataggtatatatgtaattgttatatatatatatattttttaagatagagtttcgttttgttttttaggttggagtgtagtggcgcgatttcggtttattgtaatttttgttttttaggtttatgttatttttttgtttcggtttttcgagtagttggtattatagacgtttgttattatgttcggttagttttttgaatttttagtagatatagggttttatcgtgttagaaaggatggtttcgattttttaatttcgtgatgagtttatttcggttttttaaagtgttaggattatagatattaagggaggagattattttttatgttgttttatgtttaatttttgtttttaaagaaaaaaaaagtaaaaattaaaaggtagaaatgaaatttataagtagatagttcggcgttatattttgggtttggtagttaaagatcgatttttgatttaattggttatgttatttatagattatagatattgtatagaaaagtattgtgaaaatttttattttgttttgtgacgatttaattatcgatatatgtagtttttagttatgtattttttgtttgtttaattgattacgatttttttacgcgtatttttttagagttgttagtttttaaaagggataggaattgtttattcggggagtttagtttttgagataggagttttgttgatgttttcggtttaataaattttatttttcgttaattcggtgtttgaggagttttgtttgtggttttttttgttttaatgtaagttatcgcgttcggttggtatatatataatttttaaaaataaataagtataataattaaaaaaataagattttttaaataattataatatttattttagttttattttatttatttattggttttattttgaagtttaagtaattaggtttgtttttttaattttttagaagttagtttttttataaagaaggtaataggattttggagtattaaattgtttatttttgaaattgagttaaggaattaaaaaatgtattgattttttggtttgtgatatagtttagttatatttttaattttaaattttaaaagtttttttttttattttttttttttagatagagtttcgttttgttttttaggttggagtgtagtggcggtattttagtttattgtaattttcgtttttggggtttaagtaatttttttgttttagttttttgagtaattgggattataggtgtacgttattatgtttagttaattttttgtatttttagtatagagggggttttattatgttggttaggttggttttgaatttttgattttaggtgatttatttattttagttttttaaagtgttgggattataggtatgagttattatgttcggtttaaaagagttttttaacggtgggggaatgtttatattttagtttaggttaagatttttttttataataaattgttatttgtgtataatgagggttttttttggatgttatgagagagtgggtagggaggttttttagtttgtagattttttatttttaagtggtttatcgttatatggaggttagtatatttttttgttttaagtttggagtattaatttatttgtgcgtgtaaaattatttaatttgttttttgcggattatgaagaatatttagataagagtgttttgagtgtttttttgagtgttgcgtgtggtagtttatgtttgtaattttagtattgggaggttaaggtaggtagattatttgaggttaggagtttaagagtaggttggttaatatggtgaaattttatttttattaaaaatataaaaaattagttgggtgtggtggtatgtatttgtaattttagttatttagaaggttgaggtagaatagtttgaatttgggaggcggaggttgtagtgagttgagatcgtattattgtattttagtttgggtaataagagtaaaattttatttttaaaaaaaaaaaaaaaaaaaagagtgattttcgggattgttttttatacgttggtttttatatgttagtagattatttggaaataaagggtttgtaagttgagaaatttttttgtttatttttttatagtatttaagagaaatttttattgtatataggtattaagtattttatttttatttttttttttttataatattattattattgtatatataatataatgtttaaggtgtagtaattattgattaagtatttgttggataaatgaattaataagatatgtatattatttattaaaaagtaaaaaaggaaggggttttgtaggtaaataatggtaagggtgattttggggttaagagtgtgtatgttttatttttttaagtttttttaatttgttgttgatttttggagaaattgttgttttttagtttttttttttttaaaatagggtgaggagatgataatttttaagtgttaagttattttttggtatggttggtttagttggtatggttggtttaagtggtatggtgttaaaaaattaaaaggaatagatttgatttttttaagaatttattaaatttatattttattatttattttatatatatttaaattttggtaagttgttgtgaaaatggatgttattttgaaaggtaagattagttaagggtatggggtagtttggtatagttttttttttattattagaaaaataattaatttggtcgtgtgtcgtggtttatatttgtaattttagaattttgggaggttgaggtgggtggattatttgaggtaaggagttcgaggttagtttagttaatatggtgaaattttgtttttattaaaaatataaaaaattagtcgggcgtggtggtaggcgtttgtaatttaagttatttaggaggttgaggtaagagaatcgtttgaatttaggaggcggaggttgtagtgagtcgagattatgttattgtattttagtttgggtaataagagtaaaaaattttgttttaaaaaaaaagaaaagaaaagaaaagaaaagaaaaataattaatttaagttagtttataagtagaacgtttaagaaaggatagtatatatatagataatacgaaagagtttatgttttgaggtttgagtgtatagttaaaggaaattttagttatttttatttatttgaaaatttaataatttgtttggaaaagtgaatagttttggttttttgtttattaaaaatgtaaaagattttatggagttttttattttagaaattttattatttttttagaagggatttagagggtatttaatggtatgtgaggtattgagaatttaattatttttgaaataaggttaaaatttttttttgttaaggttggggaagggtttgaggaggtaagtagatgagaatagtagtggtttttttttttttttttttattaagttgtggatataaagggttatgagtaaattagaatataattatgttaattcgaatttggttagtgaggaagtattttagttttttttggagggagggtatttattgagtttttaggttagtaatttttagtttttttttttttttagtgataaaatttttgggagaaatgggttttaataatggtttgggaaattatttttttgataaagtagtttagaaatgagtatttgtggataggggagggaagatatgtaaagagaattattttttttgcggggggggtagggttttattttgttatttaggttggagtatagtggtatagttatggtttattgtagttttaattttttaggtttaagtgattttttattttaattttttaagtagttggaattataggtatgcgttattatgtttatttaatgtttgtatttttgtagggatagggtttttttatgttgtttaggttggttttgaatttttggatttaagtaattttttcgtattggttttttaaagtgttgggattataggcgtgagttattatatttggtttatgaaaattaaaatgatttaagtattaatttttttttttttaattattttttttattatagaatttgtttattatttatttttaatttggtagtaatttatagaggtaaagaaaagagaagaaatataagagtaaaagttaaatttagaagtttagagaattgttgagttatgaaaaattagtgggacgagttaggttttttagaaattataaagtggtattttatttaattttttattttaatttttaaattaaagattggttatataaggaatgaatagagaaaataaatagggatttttaaaaataaaattattaagtatgggtaaaataatgtataaattttataaattgttagaggtaattttatttggtttttgatatagttattatttttttttagtttagtttttaaaaggattagggtttttagaggagtaggtaataatgggaaagtatttttaaatgagttttttgaattgttttttagtttttaagaaaatttgatatatttttatttaatgagttttttaagtttaatatattatttttagggttgttttatgaggatatagatttttttatgtttttttgaagaaaaggaatagtagtttgttttatttttgtttttgttttttttttttttttttttttgatatagggttttgtaggttggagtgtaatggtatgaatgtggtttattgtagttttgatatttttggtttaagtaatttttttattttagttggagtagttgggattttaggtatgtgtttggttaatttttgtatttttgtagagatagggttttattatgttgtttaggttggttttgaatttttggatttaggcgatttatttgtttcggttttttaaagtgttgggattatatgtatgagttatcgtgtttagtttatttttgttttttttaattgtatttgtaaattatattgataggttttttagtagaaaattttttaaatggttaatatgtttatattagttttttttatattagtgggtatatattttaagagaaatgaagattatagattagtttatagaaggaaattaaatgtttttataggtaagaaagatatgtaaattaattttttatttgagaatagtaaaaataaagataaaagttaaatttaatttaattggatttttttatttttttgtttatttttttttttttttttttttttttttgagatagagtttttttttgttgtttagggtggagtgtagtggtgtgattttagtttattataatttttgttttttgggtttaagtgatttttttgttttagttttttaagattatatgtatgtgttattatgttcggttaatttttgtatttttagtagagacggggttttattatgttggttaagttggtttttaatttttgatttcgtgatttatttattttggttttttaaagtgttgggattataggcgtgagttattgtgttcggttttttgtttatttttttttttaaacgattagtaattagtaaaaatggatgaattgatttgaatttcgtttttttttggttatggtagaaatgtttatatataattagttttaaagaatattagtagtggatattatgggtgtgtgtagatggttttgaaataggtagtaaaagtaaagatataattattggtttttaaattatcgagttatttgttttagtttaaaatttttaagttaattttagatttttatttaaaatatgaaaatgttttagagtgttttataaaaattttatattttaggaggtttttattattatttattaataattgtttgaatttgttgtttagttttttttaaataggtttttattttatatttatattattatagtgttggcgttagttttaggggaagatggaaaaaatagttttgggatattaggtgcgggtaattggaaattttgaaaggtttaaagttgtgtattaatttttattttattgagattatttattttttttttgataggggtgattttaatatgttatgtttttgtgatatgggtagtgatagtgtttgaagtgtggtggaaaggggattaggttaatagttaagggagttgggtttttattttagttttgttattttgagagtttggttaagttatagtatttttttttggtttgtttttttattagtaaaatgtatggttaaggttagaaaatttttaaggattttgtttgatataatgatgattttaagtgaaggaaaaaagaagtgaaagagtttatttaattttttttttatttaaaaataattaaggatatatgatattttattaatatatattgttaaattaaatttttgtttgtttgttttttgagacggagttttattttgttgtttaggttggagtgtagtggcgttatttcggtttatcgtatttttcgttgtttgggtttaagcgatttttttgttttagttttttaagtagttgggattataggcgttcgttattacgttttattaatttttgtatttttagtaaagatagcgttttgttatgtttgttaagttggttttgaatttttgattttaggtgattttgttcgtttgggttttttaaagtgttgagattataggcgtgagttatcgcgtttagttagttaaattaaatttttaaagagttatagatgtattatttgattcgaaagataatatgatttgttagtgttaggtaatttaggattatcgattattttttttaaggttttttttattttatagttgttatgtttgttaaaggatagagtttttaggttttttgaaaatatttgggaaattgagttatttggatattttttaattatgtattttttataagttataaagatttattatataaagttttttatttgtaatggtgtttttaataatagaataagttatattatttatattttatttagttttaattatggttatttgttggtttgtatgtgaagtaagaatttaagtgatagaaaagagttaatacgtttagtggggttgaaataatatacgagtgggaatattagtttttaaattaagttgggttagtggtggaggggtaatggattaattgtagaggtaggttacgatatcgtttttttttttgtttagaacgtttttttcgatagttgtagtatgtaaaaggtaaggcgttttagggattaaatttattcgtaaagggggatattgaggtttaaaaagaaagtaatttgtttagggtgacgtaataaggttttattttcgtttcgaagttaacggcgatgatatttaggcgagggattacggaattattatagtttgggttcgcgggaggggacgggacgttacgattcgtggggcggtagtcgtcgttttaagattttcgtcgtcgttaggggtgttattttttttcgaggagttttttattttgttatatagtattgtagcgttgtttttcgtaagataaaattgtttcgtaattttttcgggtcgcgggaggggttttagggtttttagaatattatttttattattattttagagggtgaattgcggtgagaatcgaaatttgttatatttttattttcgtggtttttttttaggattgtaagtttgaatgtgggtatttcgagggtttaattgtttttttttatttgaggtatttattagggatagtaattagtagcggcgcgatagtaatagggtagagtgggacgggggcggggttaagtatttaagggagagttcgattcgtttgtttcgtttatacgttataacggttagtaagtttcgttttcgcgcggcgtttgttgggatttgtagtgtttaggtgatcgggttttaggagcggttttttgtttttgatggtttttttaagttttgagtagtaattttatcgaaataaatttattttattttttggaagaagttgtttatttttttttttttttttttatatttttattttttttttttttttttgtcgtttaggttagagtgttatggtgcgaatacggtttattgtagtttcgatttttcgggtttaggtgatttttttattttagttttttgagtagttgggataattatggtgtttatacggcgttcgttattacgttaggttaatttttgtatttttagtagagatggggttttgttatgttgtttaggttggttttgaatttttgggtttaagaggtttagttgtttcggttttttaaagtgttgggattatagatttgagttatcgcgtttgggttatatttttatgttttttttttttgaatgagaaagttttatatatttgaagggttattaagaggttatttttattttttttttgggtttatttaatattattttacgaagagtttttattttttttgagataaggttttattttgttgtttaggttggtgtgtagcggggcgatttcggtttagtgtaatttttgttttttgagtttaagttattttcgtgttttagtttttttagtagttgggattataggtattcgttattatgttcggtttatttttttgtatttttagtagagacggggttttattatgttggttaggttggttttgaatttcgttttaaaaagaaaaaagagaataaatttatggttaggtatagtagtttacgtttgtaattttaatattttgggtggtcgaggtgggagattttttgagtttagaaattttagattattttggataagatagggagattttgtttttataaaaaataaaaaaattagtcgggtgtggcggtgggtttttgtagttttagttatttaggaggttgaggtggtaggattatttgagtttgggaggtggaggttgttataagttatgattatattattgtattttagtttgggagatagagcgagattttgttttaaaaaaaaaaaaaaaaaaaaaaaaaaaaagaataaatttagtaagaaaagaattttgttaagttaatttaaagaaaattttttatttttaatatttaataattttggtttgtttttaataagagttttgttaagttggtttaataagaatttttttttagtaattttttatgtagtgattttttattttgtttgttggttataaattttatttgttattattgtatttagagtgtagtataattttttttttggttttgaataaatttttttttgttattttaataagttttagaatatttttttttttaatatttagaagatgttaaatgttgtatatgttgtttatgaaagattaaatttggaagtgtttttttttttattgtttaaatgtggaaagaaatttttttgtgttattttaggtaggggaatgagtattttttttttttttttttttttgtcgagatagagttttgttttgtcgtttaggttggagtgtagtggtatgatttgggtttattgtaatttttatttttcgggtttaaatgatttttttgttttagttttttgagtagttgggattataggcgttcgttattacgttcggttaatttttgtatttttagtaaagacggggttttattatattggttaggttggttttgaatttttgattttgtgatttattagttttagttttttaaagtgttgggattataggtatgagttattatatttagcgggaatgagtatttttaatttgtttttttataagattggtggtatttaattgagatgaatagatggtgggaaatgatgagtaagttaggaagtgggttattcgtttaaagtttaaattattttttgagttattaaaataatattttttattttaaattcggtttgtagggataagtgtttttagtattttggatatattttttttaattttatttattagattttttaaaagtattgagaatgaaaattatttgtatttatatagtttattgtttatattaatatgataattattttagtaaattaaaaatgaaggttggtcgggtatggcggtttacgtttgtaattttagtattttgggaggtcgaggcgggcggattatgaggttaggagtttgagattagtttggttaatatggtgaaatttaatttttattaaaaatgtaaaagttagttgggtatggtggtaggcgtttataattttagttatttgggagggtgaggtaagagaatcgtttgaatttaggaggtagaggttgtagtgaattaagattgcggaggttgtagtgaatcgagattgtatttttgtattttagtttgtagttttatttatttaggaggatgaggtaggaggattatttgagtttaggagtttgagtttgtaatgagtagtgattgtatattgtattcgagttttggtaatagagcgagattttgttttagaaagaaaaaaataaaaaaaaattaaatttgtttttataaaattaataaaaggttatagatttagaattatgagaggggtttgaattttgttaacgtgttggtatagttaaatgattattagttattattttggaggttataagatttataatttttttaattatttttataaataatattattattgtagaatttaagattggttttttgatagatttttttagattttggtatttttgataattagatggttttattagaatttaggatttttaattggttttgtgattttttatttagaaatagatttagtatataagaaatattttttatatttttgtgattgtatttttaattaattagtagtatttattttttagttttttgtttgttaaattatttttaaaaaatttagtttttaaatttttagaaagattgatttgaataataataaaattttgtttttttatttagttggttttatgggtattaaattttttttttattataatttttcgttttgataaattggttttttttgagtagtggataagaattcgttgggtgtttatataatcgttggttttaaaatattttgttgtgtttattagttttaaatgattgtattatgatttttattttattttaattaatttttaattcgtattgaaagagtttatatttaaattaaattttaaagatttagtatatattattatgtgttttttattttgagtttttataattttgttaaagtagtgttttttttattgtagtaaggataaattagattttgttttattaataggttattttgttgatatttttagtatttaaatttaatagtataaaataaaatagttagtttgatttttttttttttttttttttttttgttttttttttttttacggagtttttttttgttgtttaggttggagtgtagtggtatgattttagtttattgtattttttgttttttgggtttaagtaatttttttgttttagttttttaagtaattgggattataggtgtttattattacgttaggttaatttttgtatttttagtagagatagggttttattatgttggttaggttggttttgaatttttgattttaggtgattcgttcgttttggtattttaaagtgttggttggtattataggtatgagttattgtatttgtttttttttttttgtttgtttgttttttttttttttaagtagagatggggttttattgtgttgtttaggttggtttcgaatttttgggtttaagtgatttttttgttttagttttttaaagtgttgggattataggtataaattattatgtttaggttagtttgatttatgtatttatgtagttatttatttatttattgagatggagttttgttttgttatttaggttggagtgtagtggtgtgattttagttaattgtaatttttattttttgggtttaagtgatttttttgttttagttttttaagtagttgggattataggtgtatgttattatgattagataatttttgtatttttggtagagacggagttttattatgttggttaggttggttttaaatttttgattttaagtaatttgtttatttcgggtcgggtgcggtggtttacgtttgtaattttagtattttgggaggtcgaggcgggcggattacgaggttaggagattgagattattttggttaatacggtgaaatttcgtttttattaaaagtataaaaaattagtcgggcgtagtggtgggcgtttgtagttttagttattcgggaggttgaggtaggaaaatggcgtgaattcgggaggcggagtttgtagtgagttgagatttcgttattgtattttagtttgggtgatggagcgagattttattttaaaattaaaaataaataaataaataaataaataaaattaatttgtatatttcggttttttaaagtgttgggattataggcgtgagttattgagttaggttttaatttgatttatttttaatagaaatgtcgtgggagggttgtagttgtaattttttataattggatatggaaggaataggaatttatatttagatttatagagaaaattttttatttttatttttaattgttaagttttagggtaaaaaaaaaaaaaaaaaaaaaaaaaagattgaggcggtatgtggttattttgtgtatgatatagtagattattttattttatttttttaagggaagtatttttattattcgtattttatagatgagaaaagtaaggtttagagatataaaattatttttttatgtttatatagttaataagtgttattaga

SEQ ID NO: 105 - DNA, 15832 bp, Artificial Sequence
  chemically treated genomic DNA (Homo sapiens)
  unsure (791, 2400, 3281, 4994, 5001..5002, 5006, 5012, 5016, 5024)
  unsure (5221, 5244, 6508, 12917, 12968, 12987..12988, 13055)
gagtgtaagtatgggtagtataataattagaagatgttttttgtttgtagagaggagtggtattatagtttttattagagatgagaattgttaaagtttgagagatttttagagtattaatagataggaattaaagtaatattagaagattttgaagatgtttattgggtttatttttattggaaatatttgggtgtttgaaagatatttgaaattttttttttgttattgagttattggtattttattatagatgaaaggggaaaaggtaaggtttggggtagataaagtaaatattggtttttttttagaaatgttttggattttataaaagattggaataaattagtattgtttataattaaatgtttattttgtgttagatagtgattaaattttattttttgtgtttttttcgatttttataaaagtatttagagtttaggtatggtggtatgtattcgtggttttagttattagggaggttgaagtgggaggattgtttgagtttaggagttttgggttgtagtgtattaaatcgattaggtgtttgtattaagtttggtattaatatagtgattttttaggagtgagggattattaggttgtttaagtaggagtgaattagagtaggttagaatttttattttgagtattagtaggatcgtatttgtgaatagttattgtatttttgtttggttaatatagtaagatttttgttttttttaaaattttaattttttttttaatttaaatttttatatatttttatttttttttttttttttttntgagatagagttttttattatcgtttacgttggagtttagtggcgcgattttagtttattgtaattttcgtttttcgggtttaagcgatttttttgttttagtttttcgagtagttggaaatataggtgtttgttattacgtttagttaattttttgtatttttagtagagatagtattttattatgttggttaggttggtttcgaatttttgattttgtgattcgtttattttagttttttaaagtgttgggattataggcgtgagttattacgttttgattttttatttttaaaatagagatagggttttattgtgttatttaggttgggtttcgtttttttgggtttaagcgatttgtttgtttgggttttttgaagtgttgggattataggtgtgaattattatttttggttaatttaggttttttttaaattatattatgttgttttttgggtggaaattgaagtagaagtagtagtattaaagtgttaggaaaagggataatcgtattataggattggtttttttagttattaatagattttttttaatttttaagtgtattcggtttgtgtaatagttttggtatattttttgatattggtatgttaattttttttgggatggtaaattatatggtttgtgggttttggggaaagttattgtgtgaggaatttttttttttgattttttttttttttttgagataagagttttgtttttattgtttaggttggtgtgtaatggcgtgattttggtttattgtaatttttttttttcgggtttaaacgatttttttgttttagttttttgagtagatgggattataggcgttcgttattacgtttttttaaattttgtatttttattagagatggggttttattgtgttggttaggatggtttcgattttttgattttaggtgatttatttgtttttgttttttaaagtgttgggattagagatttgagttatcgtgttcggtcgaggaattttttttttgttgagagaagggatataaaggagaaatttttttatattagtttaaatgatttagaaataaattttgttttaatattatgttttttttgtagaaagttgtttaggttaagagtaaatagtttagattttttcgtttttttgttttttatttgagttaggttattatggtatgtgtttaaattatttttatttaaataaattttttttttttttttttttttttgagatggagttttatttttgttgtttaggttggagtgtaatagttcgaatttagtttattataattttttgttgttcgggtttaagtgatttttttaatatagtttttgagtagtaggagtttttgtaggtttttatgaacgttgttgtcggttataggtataatatttgaatcgtgggattagagattgtagtgagttaagattgcgttattgttttttagtttgggtaatagagtgagattttgttttaaaaaaaaaaaaaaaattttttatagagatggatttttgttttgttgtttaggatgattttgaaattttggttttaagtaatttttttgttttgggtttttaagtattgggattataggcgtgagttttngtattaggttttgtgtttaattttttgaggaattattaaattatttttcgtagtggttgtattattttatattattaataacgtttgagggttttgattttttttttttatatttttattaatatatggtatttttagagttttttggttttgtattttttttatagttattttagtggtggttgtaaattatggtgttttatggttttgatttgtatttttttaatgattaatgattttttttttttttgagacggagtttcgttgtgttttttaggttggagtgtagtggtgtgattttagtttattataagttttgtttttcggatttacgttatttttttgttttagttttttaagtagttgggattataggcgttcgttattatgttcggttaatttttttgtatttttagtagagatggggttttatcgtgttagttaggatggtttcgattttttgatttcgtgatttattcgtttcggttttttaaagtgatgggattataggtgtgagttatcgcgttcggttttttaatgattaatgatttgcgtatttttttatatgtttgtttatttgtatatttttttttttgagatcgagttttgtttttgttgtttaggttggagtgtaatggtgtaatttcggtttatcgtaattttcgttttttaggtttaagtaattattttgttttagtttttagagtagttaggattataggtatgtattattatgtttggttattatttgtatttttagtagagatgggggttttattatgttggttaggttggtttcgaatttttgattttaggtgatttatttgttttagttttttaaagttttaggattataggtgtgagttattgtatttggtcgntttttttttttttttttttttttgagatagggttttgttttgttatttaggttttcgagtgcggtggtataattatggtttattgtagtcgtgattttttaggtttaagtgatttttttattttagttttttgagtagttgggattatagatgtgtgttattatgtttagttaatttttgtatttttagtggagatgggtttttatcgtgttttttaggttgattttaaatttttgggtttaagtaatttttttattttggttttttaaagtgtttttttttttttatgttttttttattttagtttgtttttttatattgatatggtacggtatgtttgtgtgcgtgtatatagatataatgtttgatcgtagagattaggaagattttgttaaatttatttggaattttttgttgacggtagggaaaatagatgtaaggaaggtgggtgttagggaatagggaggtagtatgaggagagggattgatagaagaagataaagatacgggtgagggtttgttgagaattttaagttatttaagtagaaagggatttttaaggttaatttgtttaattttttggttttataaatgaggaaatagaggtttagagaagtgagatggtttgtttaatattatattgttgttttgtggtagagttgtaattagaatttaggttaaaagaaaagggattggagggtagtgtatatttaaggttttaaagagatattgtttagaaggagaaagagagattgatattttatagaaagaattgatgaatgtagatttttagtagaggtttggagtatgaagatataggggtaggaggggaaggtgtttagaagatattatagttaggtagagttaggttttggattttattttgttattatttattagttttagttttagtttttgatgtatttttagaatttttgtgaaaattagttttttttttttttttttttttgagatatagtttaattttgttagttaggttggagtgtagtggcgcgatttcggttttttgtagtttttattttttgggtttaagtgatttttttgttttagtttttcgagtagttgggattatagatatgtgttattttattacgtttagttaatttttgtatttttagtagagacggggtttttatgttggttaggttggtttcgaatttttgattttaggtgatttatttgttttggttttttaaagtgttgggattataggtttgagttatcgcgttcgatgaaaattaattttataaattaagtttgtaatattagtatagtttttaataagtgtttattaagtttttattaaggttatattattttagaagaggaaagatttttgattgtatgggttaaggtatggtttaaatgattttgtgaggatataggatagaggtttagtgtttttagagtttattttttttgtgtttttgttgtttgtaattgataaattttttatttggtttaggtaggggagtttagggttaggataggaggagagggtagagttgttattaattattaggtttgggttatattttggagaggaggaggggttgtttgtttgtttttttttataatttgtttttggggatttttaagtatatattgttattattttggaaagaaaaggttgagaacgtaaaattgaggatagaggaggaaagtagggtgatttttgatgttgttttaganaatggannntanggagtngtanaatagaanattagaagatttgattttgtttttagttaggaaaatagtttgggggagtaaaaagtattagggaaaagagtgggtattttgtttggaaaaaaggtaaagattttttgtgttattaaaggaattgattgtgtttatagttggcgagaaggagattataatataggaaaagatttgtcgtttgttggattattagtttnggtgagattatcgatatttcgtntaaaaggaatattcgtgtttttttattttaaaaaaaaaaaaattgtataatttagggatttttttttttttttttttttttgagatggtattttattttgttatttaggtgggagtgtagtggtgtaattacggtttattgtagttttaattttttgggtttaagggatttttttattttagttttttaagtagttaggattataggtgtaagttattatgtttgagtaatttttaaattttttgtggagataggagttttgttatgttgtttaggttggtttttgaattgttgggtttaagtgatttgtttattttagttttttaaagtgttgagattataggcgtgagttattgcgtttagtttaattaaattattattattgtttttttttgagatagagttttagtttgttgtttagattggaatgtagtggtgtagttttggtttattataatcgtagttttttagatttaagtagtttttatgttttagttttttgcgtagttaggattataggtgtgtattattacgtatagttaatttttgtatttttagtagagacggagttttattatgttgtttggattagttttaaatttttggttttaagtgattcgtttgtttcgtttttttaaagtgttgggattataggtttgagttatcgtgttcggttacgttattggaagttttatgtagaaatatgtaaattaattatgtggtttatatgttatatttttttaagtttggttagtataagtgagtttttttaagatgaattaattgattaaaattgatatgggtatttaagttaaagtttgaatgtttttttttttttttttttttgagatagggtttttatcgtttaggttggagtgtagtgatgcgatttcggtttattgtaattttaatcgttttggttttagggatttttttattttagtttttttagtagttaggattataggtatatattattttatttggttaatttttgtattgtttggtagagatggggttttattatgttggttaggttggttttaaagttttgattttaggtgattcgttcgttttagttttttaaagtgttgggattataggtataagttagcgtgtttagttttaatgtttttaggaaaaaaaagttagtaatgtttttatttttgatagtttaattaatttaggtgtggaaggagttttattttatatgtttaggagagatagtgagaggaatttttttgtttggtttttttattttatntagtaagtagatttagaaaagtaatttaaattgtttagggttatataatttaattagataaggttttagatattaatttttaatttagggttgtaatggtttttgttttggtaattatagattggttttattttagttattgtataataaaaaatagtatagggttattatagtagagttggggtaattatagttgttgatttggagatgtgggcgaattttttttataaaattaggttttggggagataatagaagggtgatattttttttttgagattgagttttgtttttgttgtttaggttcgagtgtaaaggcgtaatttcggtttattgtaattatcgttttttgggtttaagcgatttttttgttttagtttttcgagtagttgggattataggtatgggttattacgttaggttaattttgtatttttagtagagacggggtttttttatgttagttaggttggttttaaatttttaattttaggtgattgttcgttttggttttttaaagtgttacgattataggtataagttatagtttcggtattttttttttttttttttttttttataagataaaaaaatttttgttgtttaggttggagtgtagttttaattttttgggtttaagtgatttttgtattttagtttttaagtagttggattataggtgtgtgttattatagttggttagtttttaaattttttgttgagatagggttttattatgttttttaggttggttttaaatttttggttttaagtaatttttttgttttggttttttaaagtgttaggattataggtataagttattatatttagagatggtatttaatttaataatagtttggttttgtttttgaggtgtaggaggtgtttttttaatatatgattatgatgaaaattaagattataaaaaagaagatttttggggttatgtagttgtaatttttatttagtagtttgaggtgttacgtggatgaatttttttgattgttatttaaagatttatttttattttttaattattttattaattttttttaggattatattatatatagtaatttgtataaagaataacgttgttagggggtagaattgaatgttagttatgtatttagaggaatttaattttttttatttttttatagagttgtgaggggatgattttttttaggaagagggatattttttttatttttttttttttttttttgagagaagattttattttgtcgtttaggttggagtgtagtggtaagattttagtttattgtaatttttgttttttgagtttaagtgatttttttgttttagatttttgagtagttgggattataggcgtacgttattacgtttagttaagttttgtatttttagtagagatggggttttattatgttggttaggttggttttaaatttttgattttaggtgatttattcgtttaggttttttaaagtgttgggattatagacgtaagttattgtgttcggttgtttttttttattttgataaggtagaaggttaagtatgtgggaatagatataagtaaattggtggattttggtattggaaaaaatgaggtagttttatttaaatgtatttattttattaatgaaatatgaagtaagattatttgttgagagtgaattggaggtggtattggagatgttagaagagagaaggtgtgaaataattattatgtagggtagaaaagagaatttattagggaaatatagaattatttgggagtgttgcgttttaggggtatttttttttttttgagatagagttttgttgttatttaggttagagtgtagtggcgcgttttagtttattgtattttttgttttcgggtttaagttatttttttgttttagttttttaaatagttgggattacgggtatgcgttattacgtttagttaatttttgtatttttagtagagacggggttttattatgttggttaggttggtttcgaatttttgattttaagtgatttgttcgtttcggttttttaaagtgttaggattataggtacgagttatcgtatttattttaggggtataaatttaaagtgatgttagttagttagatatagagatttttttttttaatatttagttatttaggtatatatatggagaagttgaattgttggatttaattggaatttgatttttttttaggaaagttttatggagggtaagagggataaggaagttaataatgtttgtaagtttatggttttggatgtgaaggggagtgagtggattatttaaaaaataaaagatcgggtatagtgatagatatcggaatagttacgatagtagtttttaatagcggtatagtagtttattagggcgtggtggtacgcgtttatagttttaattacgcgggaggttgaggtaagagaatagtttgaattcgggaggtggagattgtagtgagttaagatcgcgttacgtgcgtattttagtttgggtgatagagtaaggttcggttttaaaaaaaaaaaaaaaaaaaaagaatttttaaggtttaaatgggtagagaaaaggataatagaataaggagtttagaaaaaatattttataatttatgttaattttattaggtattttagaattttgatggaatattgattatttgataaatttatataatagggattaataggaaatcgaagataaaatagttttttgaaggaatgtggtagggaatcggtaatggagagttaaatttgggaaattattaggaggagtttgtaacgataaaatatttgtattttttttttataatatggggcgagtttggtggtttggtaaattaaaattagggtattatttataatgttaaaaataaggggtaatttgaagggttttaatttagtacgtttataggtttgtgtattttaaggagtttatgtgttgtttttaattttttatcgattttatgtttttttttcggtagggttttttattttaaattaaggttttagtttttatattaggttatatatttattttaaaggttagtagaacgtttagtttttaagaattattcggaatttttttttttcgttttttattcgggttgaattttgattttcggtttttgtggatattatagtatttttgttgtttttttagtttttattaaaattagcgtttttattttgtttcgtagttggtgtcgacgtggagtcgtaaaagaaacgtcgtcgttgattggttatacgtttttattaggtttcgtttaggataaggattattgggtaaggtttgttttattggttaattattgtattagtttgtttatcggaagtaaagtgtttaattagaaggtttaggtgtttgattgttagtttgaatatttaataaaacgttaaaattttacgatttattggggcgggagggttagtggggcggggttgtttttatggggaatagaagaagcgattgttaatttttaattggtagggtcgaggatacgtgatattgtcggattgatttagcgatttttaaatcgtattttttttagggggcgttgtgtttttttagtttttaatattggcgttttttaatcggaattttgttttaatttttatttttagcgttcgtattaggtttatgatttttgtggttagttttttttttatgttcgtttaggttattttagtatttttatagaaagtttgtataattatagagtagagttaagaaaggtttaatatgttaattatataaattaaggttgttaggagttgatagtcgtaataataatttttttaaggtggagttttaggttttgttgggtttgaggaatatgagaagttagtttgtaaaggttaatttgagtttaacgtgaaatcggttttggagatggggtttgcgggataaacggggaaagggatgggattagaataagagaggggttatagggagtaaattttggggttttttaatagaaataagtcgttgtgtttgggcgcggtggtttaagtttgtaattttagtattttgggaggtcgaggcgagcggattatttgaggtcgggagtttgaaattaatttgattaatatggagaaatttcgtttttattaaaaaaaaaaaatataggtcgagcgtgatggtttatatttgtaattttagtattttgggaggtcgaggcgggcggattacgagattaggagattaagattattttgattaatatagtgaaatttcgtttttattaaaaatataaaaaattagtcgggcgtgggtggcgggcgtttgtagtttttgttattttggaggttgaggtaggataatggcgtgaatttaggaggcggagtttgtagtgagttgagatcgcgttattgtattttaatttgggtgatagagcgagatttcgttttaaaaaatatatatatatataaaattagtcgggcgtggtggaatatgtttgtaattttagttattcgggaggttgaattaggagatttatttgaatttgggaggcggaggttgaggtgaggcgagatttcgttattgtattttagtttgggtaataagagcgaaattttattttaaaaaaaaaagaaaagaaaagaaaaggagaagagaagagaaaagaaaaggagaaagaaagaaaagaaagaaagaaaggaaggaaggaaggaaggaaggaaagaaagaaagaaagaaagaaagaaagaaagaaagaaagaaagagaaggaaagaaaggagaggaaagaaatgaggcgttgtaaaatgagaaaagagaagtttattgaatgtaagaattttagaatagggaatgattttgaagaaggggtttttttaaaggttcgtgtagtaaatatttattagagttgcgggtttattatattgattaggttggtttttaacgttcgattttaggtgatttatttattttagtttttaaagtgtagggattataggtgtgagttattaattaagttcggttaatttaatttttttgagttttattttttttttgagttttattgaaaaatggagataataatgagaatgtttatttagcgaagttgttaggaatatataatgggattaatataaaaattagtttgttatttattagatgaaagtttagatatttggaggttagagtgatttaagggtttgaggaatttcgaatgttttatttggaggttagattttggtagagagatgtttgggataaattgaagttagtaaagagtttgattttgggggagagtaagagttaggttgtattagtgttggcggggaggggtggtggttagatttttaggaattagtttgtaggtcgtggtttttttattttagtattattgggcggggttagttttagttacgttatgggtatagtgttaggtttatgggttttagttattttttaggaattttagaattttcgttttattttatattgttgtaattttttaaagtgggtggagttgtttaggaagttttattttttgtttttttttagaggatggaaggttagatttttggttatttattaatttttttttataggtattttttttattttagatttttatttttgtttttgttgtttttttttatttggaatgttttttttggttttttttattaatttgaggtagtgtggagtagacgagagatttgggtttgagttttagtttagtatttagtagcgtggatttgggtaaattatttaatttttttgaattttagtttttttttggtaatgagtgagaatagaggttttattataggttgtgtaagggattagatgaagtaatgtatatatagtgtttatataggaaatatattaatgttggttttttttttataatttattttttaaggagagtttattattattttaggaatgtaatattttttttggttatttttatatatatatatagtttttttttttttttttttttttttttttttttttttttaaatttttttgagatagagtattatttttgttagttaggttggagtgtagtggcgtaatttcggtttattgtaattttcgtttttcgggtttaagtaattttttgttttagttatttgagtagttgggattataggtatttattattatatttggttaattttttgtatttttagtagagatagggttttatattttggttaggatggttttgaatttttgattttgtgatttatttgttttagttttttaaattgttgggattataggagtaagttatcgtgttcggttaatttttgtagagatagggttttattatgttggttaggttggttttaaatttttgattttaggtgattttttcgttttagttttttaaagtgttgggattataggtgtgagttattatgttaggtattttntagttttaaatggttgaatttgatgattgtgaaatgggtaggataaagatnaattaaatttttagttttnntaggaatgtaaagttttaggattttttttaaaatttagaaagtttgtttgttggaaaattttttttntttgagacggagttttattttgtcgtttaagttggagtgtagtggtttattgtaattttcgtttttcgggtttacgttatttttttgttttagttttttgagtagttgggattataggcgcgtgatattatgatcggttaatttttgtatttttggtagagacgggttttattatgttggttaggttggttttaaatttttgatttcgtgattcgttcgtttcggttttttaaagtgttggattataggcgtgagttatcgcgttcggttttgttggaggattttttatttaggggttatatagtttttaattttttaattattatggaagtgaaagaattatagaaatgagggataaagtagtattgttgggaagagagatgaattgaataaggagaaattagattatattttagatttgaggtttgagagtattattagaatattttgtttttttagtttggtaatttaggagtttttatttaaataatatttagtaaaggaaaaaaattaaaaggggttagatttatttttgatgagttttgggttacgatttgtattatgatttatttttttatttttttttatatttttttgtttttgtttttgaaaataaaaagttagtttttgagagattgaattgatagattttgtgttattttttagtttatttatgtttttaaattaatttcgaggtagaattgttttatttttttttggttttagtttttttttaaaattatataatagaaaaggagttgtagaaaattagttgatcgagttatttagggtaattggttatggatgggatatttgtattgagagtgagaaaataggtcgggcgtagtggtttatatttgtaattttagtattttgggaggttaaggtatgtggattataaggttaggagttcgaggttagtttggttaatatggcgaaatttcgtttttattaaaaatataaaaattagttaggtatggtggtgggggtttgtaattttaattattcgggaggcggaggaaggagaatcgtttgaatttggaaggtaaaggttgcggtgagttaagattatgttattgtattttagtttgggtaataagagtaagattttgttttaaaaaaaaaaaaaaaaaaaaaaaggagtgtgaaaataaaaagttaaataaaaaagtaggttttatttgtagtatatataatttagattatataataggaaggattttttgaagagatgggtgtggttaaatattagaagaggtgatataggttagggaatgtaaggttaggagagatttttttaataatttgatgtaaggaaatttattttgtttaaaaataggagggatagaatgtgagagggtttttgttagtataagtattttataagtgtatggatttattttttgaatttatttttattagttgttttttgggtattttgttttttttttttttaattattttagtataagtgggtatataggtattgattttttatttttgttttatttgatttgtttttttagtttttttttttataatttgtttttttgttaatatttaaattttaattaagttatgttaatggagtaaagtaagaaatagtagtaagtatttagataaaaaagattttaaatttgttattaggtttcggtaaaaatttggataattgtatttattttttgttttttaggtagatttggttttttagggtttggttttttttatatggaggtttttttttttttttttgattatgtgatagtttttttagatttttgatataatttatattttgttagggattaatttttttttattattgtgaagaagagggaaaaaatatatataaatacgtcggaaatttataataaggtttttttggagggtaagatatggggagagttagaagtagcgttaattgttttttgggggttttagtttaagtcgaggtttgtttttagtaattaattattaaaataagttggttagagtaatagtatagtttattttgattatttaatttgaagtgttaataaattaaattttaattaattaaattaggtgtgtaataatttagatggatatttcgatattaatataattataataaaaatttttattgttgttagggattttatcgggggtagtgttggtattgttcgcgttttagttgagaaatatatttttatagcgtaggaatgaggagattgttttttttaataaaatggagggggttaggtattagtaaggacgtagttgggagaggggtataggggattgttaggaacgagatgggagtgttttaggggtttaatgtaattgatatttttgtttagagtagggggaggggggtatttaggttaagtatttttattgttagggttaaaggaatttaataaaagttttattaagatgatttaggaagtaaaggttaaggagtaatattaatttttaaagttattgatatattttgtatagtttttttttttatatatatttatatttttgtgtattttggatggtttgattttttaatgaggtttagaagttttagtagttaatttagtggttatagttttggcgaggtgatagattataatataggaaaagattttttattttaagtgattgatgaatttagtatgagtgaggatggggaggaggcggttttttttttttttaggggaagttggagggagtttttttaaggaggtagtgtaaatttgttgattttagtaggtgtagttttaatatttttttttttttgatatagg

SEQ ID NO: 106 - DNA, 15832 bp, Artificial Sequence
  chemically treated genomic DNA (Homo sapiens)
  unsure (2778, 2845..2846, 2865, 2916, 9325, 10589, 10612, 10809, 10817)
  unsure (10821, 10827, 10830..10831, 10839, 12552, 13433, 15042)
tttgtgttaaaggaaaagaggtgttagagttatatttgttagggttagtaagtttgtattatttttttggaggggttttttttagttttttttgagggaaggagagatcgttttttttttatttttatttatgttggatttattaattatttaagatggaaagtttttttttgtgttgtgatttgttatttcgttaaaattatggttattgagttaattattagagtttttaagttttattaaaaaattaggttatttaaagtgtataaggatatgagtatgtatggaggaggaaattatgtagaatatgttaatgattttaaaggttgatgttgttttttggtttttgttttttgaattattttaatggggtttttgttaaatttttttggttttaatagtagaggtatttggtttaaatgtttttttttttttgttttgggtaaaggtattaattatattaagtttttaaagtatttttatttcgtttttggtagttttttgtgttttttttttagttgcgtttttgttggtgtttggttttttttattttgttaggagaagtaatttttttatttttgcgttgtggagatatattttttagttagggcgcgagtagtgttagtattgttttcggtgaggtttttggtagtaataaaaatttttattgtgattatgttggtgtcggggtgtttatttgggttattgtatatttagtttaattgattgaagtttaatttattgatattttaaattaaatgattagaataaattgtgttgttattttggttagtttgttttaatggttgattgttggaagtagatttcggtttgaattaaaatttttaaagagtaattgacgttgtttttaattttttttatgttttgttttttaagaagattttgttatagattttcgacgtatttatatatatttttttttttttttttatagtggtgggaaagagttggtttttggtaaggtataaattatattaaagatttaggggagttgttatatggttagaagaggaggagggggtttttatgtgaggaaaattagattttgagaagttaggtttgtttgggaggtagaggatgagtgtaattatttaggtttttgtcggagtttagtggtaggtttagggttttttttatttagatatttgttgttgttttttattttattttattgatatggtttgattagagtttggatgttgataagaaaataggttgtggaaagggaaattagaggagtaaattagatggagtagggataaagaattagtatttatgtatttatttgtgttggagtaattaggaagaggaaaggtagagtgtttaggggatagttgatgaagatggatttagagaatgagtttatgtatttgtaagatgtttgtgttggtaagggtttttttatattttgttttttttgtttttgggtagaataggtttttttatattagattattagggggattttttttggttttatattttttagtttgtgttattttttttggtgtttgattatatttatttttttaggaagttttttttgttgtgtaatttaagttatatatgttgtagatgaagtttgtttttttatttggttttttatttttatatttttttttttttttttttttttttttgagatagagttttgtttttgttgtttaggttagagtgtaatggtatgattttggtttatcgtaatttttgttttttaggtttaagcgattttttttttttcgtttttcgagtagttgggattataggtttttattattatgtttggttaatttttgtatttttagtagagacggggtttcgttatgttggttaagttggtttcgaatttttgattttgtgatttatatgttttggttttttaaagtgttgggattataggtgtgagttattgcgttcggtttatttttttatttttaatgtagatattttatttatagttaattgttttggatagttcggttaattaattttttgtaattttttttttgttgtgtggttttagagggagattaaaattagaggagaatagagtaattttgtttcggggttgatttgggggtataaatagattgaaagataatatagagtttgttaatttagttttttagagattagttttttgtttttaggagtaaaagtagggagatgtgggggggagtaaagggataaattatgatataaatcgtgatttaggatttattaggaatggatttagttttttttgattttttttttttgttgagtgttatttaagtgagggtttttggattattaaattgagaaggtagaatgttttaatggtgtttttaggttttaggtttggagtatagtttgatttttttttatttagtttatttttttttttagtagtattgttttgttttttatttttgtgatttttttatttttatgatagttgaagaattagggattatgtgatttttgggtaaaaaattttttagtaaggtcgggcgcggtggtttacgtttgtaatttagtattttgggaggtcgaggcgggcggattacgaggttaggagtttgagattagtttgattaatatggtgaaattcgtttttattaaaaatataaaaattagtcggttatggtgttacgcgtttgtaattttagttatttaggaggttgaggtaggagaatggcgtgaattcgggaggcggaggttgtagtgagttattgtattttagtttgggcgatagagtgagatttcgttttaaanaaaaaaaattttttaatagataggttttttgagttttgagaaaggttttgagattttgtatttttannaaagttaggggtttggttngtttttgttttgtttattttatagttattaaatttagttatttgaagttgnagggtgtttggtatggtggtttatatttgtaattttagtattttgggaggttgaggcgggaggattatttgaggttaggagtttgagattagtttggttaatatggtgaaattttgtttttataaaaattggtcgggtacggtggtttatttttgtaattttagtagtttgggaggttgaggtaggtggattataaggttaggggtttaagattattttggttaagatgtgaaattttgtttttattaaaaatataaaaaattagttaggtgtggtggtaggtgtttgtaattttagttatttaggtggttgaggtagagaattgtttgaattcggaaggcggaggttgtagtgagtcgagattgcgttattgtattttagtttggttgataagagtgatattttgttttaaaagaatttaaaaaaagagagagagagaaagaaagaaagaaaagaggattatgtgtatgtgtgaaagtagttagaaagggtgttgtatttttagagtagtaatgaattttttttggagagtagattataagaagggaattaatattaatgtgttttttgtataagtattgtatgtgtattgttttatttgattttttatataatttgtgatggaatttttgtttttatttattattaaggggaaattgaggtttaaggaggttagataatttgtttaagtttacgttgttaggtgttgagttgagatttaaatttagatttttcgtttattttatattgttttagattggtagaaagggttaaggaaggtattttaggtagaggggagtagtaggggtaaagatggaggtttggaatgagaaggatgtttgtgaaaagaagttggtaaatggttagggatttggttttttattttttaaggaggagtagagggtgggattttttaggtagttttatttattttagagggttgtaatagtgtgaggtggggcggaggttttggggtttttggaaggtgattgaagtttataagtttggtattgtgtttatggcgtggttggaattagtttcgtttagtagtgttgggatgggagagttacggtttgtaggttagtttttggaagtttagttattattttttttcgttaatattagtgtagtttagtttttgtttttttttagaattaggttttttattggttttagtttattttaagtatttttttattagagtttgatttttagatagggtattcgaagttttttaagtttttgggttattttggtttttaggtatttaagtttttatttaataagtaatagattaatttttgtattgattttattatatatttttaataatttcgttaagtgggtatttttattattgtttttattttttaataaagtttagaaaggaaataaagtttagaaaggttaggttggtcgggtttggttggtggtttatatttgtaatttttgtattttggaggttgaggtgggtggattatttgaggtcgggcgttagagattagtttggttaatgtgataaattcgtagttttagtgaatatttattatacgagtttttaagagaattttttttttaaaattattttttattttgaaatttttgtatttagtaaatttttttttttttattttgtaacgttttatttttttttttttttttttttttttttttttttttttttttttttttttttttttttttttttttttttttttttttttttttttttttttttttttttttttttttttttttttttttttttttttttttttttttttttttttttttttttttttttttttttttttgagatggaatttcgtttttgttgtttaggttggagtgtaatgacgagatttcgttttattttaattttcgttttttaggtttaagtgagttttttggtttagtttttcgagtagttgggattataggtatgttttattacgttcggttaattttgtatatatgtatattttttgagacggagtttcgttttgttatttaggttggagtgtagtggcgcgattttagtttattgtaaatttcgttttttgggtttacgttattgttttgttttagtttttagagtagtagggattataggcgttcgttatttacgttcggttaattttttgtatttttagtagagacggggttttattatgttagttaggatggttttgattttttgatttcgtgattcgttcgtttcggttttttaaagtattgggattataggtgtgagttattacgttcggtttgtattttttttttttagtagagacggggtttttttatgttggttaggttggttttaaattttcgattttagatgattcgttcgtttcggttttttaaagtgttgggattataggtttgagttatcgcgtttaggtataacggtttgtttttattggaaaattttagaatttattttttataattttttttttattttaattttattttttttttcgtttgtttcgtaaattttatttttaaagtcgattttacgttgagtttaagttggtttttataaattgattttttatgttttttaggtttagtaaagtttggaattttattttagggagattgttattgcgattattaatttttggtagttttggtttatgtagttaatatgttgggttttttttggttttattttatggttgtgtagattttttgtgaggatgttgaagtgatttgagcgagtatgagggaagggttagttatagagattatggatttaatgcgggcgttgaaaatagggattagggtaggatttcggttagaaagcgttagtgttaaaggttaaggagatatagcgttttttaaagagggtgcggtttaaaaatcgttaaattagttcgataatattacgtgttttcggttttattaattgaaaattaataatcgttttttttgttttttatggaaataatttcgttttattaattttttcgttttaatgagtcgtgaggttttggcgttttattgagtatttaagttgataattaaatatttgagttttttggttggatattttgttttcggtaagtaagttagtataataattggttaataaagtaagttttatttaatgatttttattttaggcggggtttaatgggaacgtatggttaattagcggcggcgttttttttgcggttttacgtcggtattagttgcggggtaagatggaggcgttgattttggtaggagttggaggggtagtagagatgttgtggtgtttataggggtcgggagttagggtttagttcgagtgggagacggggaaagagagtttcgggtaatttttggggattgagcgttttgttgatttttggaataagtgtgtggtttagtgtaggagttaaagttttggtttagagtaggaagttttgtcggggagagggtatagagtcggtggaaagttgaaggtagtatatggattttttaggatatatagatttgtaggcgtattggattaggattttttaggttgttttttatttttagtattgtggatgatattttgattttaatttattaaattattaaattcgttttatattgtaagaaaagaatatagatgttttgtcgttatagattttttttgatggttttttaagtttgattttttattgtcgattttttgttatatttttttaggaaattgttttgttttcggttttttgttaatttttattatataggtttgttaaataattagtattttattaaagttttgggatatttgataaagttagtatggattgtggaatattttttttagattttttattttgttatttttttttttatttatttagattttaggaattttttttttttttttttttttttgagatcgagttttgttttgttatttaggttggagtgcgtacgtggcgcgattttggtttattgtaatttttatttttcgggtttaagttatttttttgttttagtttttcgcgtagttgggattataggcgcgtgttattacgttttgatgaattattgtatcgttattaaaggttattgtcgtaattatttcggtgtttattattgtgttcggttttttattttttaaataatttatttatttttttttatatttagaattataaatttgtagatattgttaatttttttgttttttttgttttttatagaatttttttggaaaaaaattaaattttagttaaatttaataatttagtttttttatatatatatttaggtagttgaatattgaaggagaaaatttttgtatttggttaattagtattattttaaatttatgtttttaagatgggtgcggtggttcgtgtttgtaattttagtattttgggaggtcgaggcgggtagattatttgagattaggagttcgagattagtttggttaatatggtgaaatttcgtttttattaaaaatataaaaattagttgggcgtggtggcgtatgttcgtaattttagttatttgggaggttgaggtaggagaatagtttgaattcggaagtaggggatgtagtgagttgagacgcgttattgtattttagtttgggtgatagtaagattttgttttaaaaaaaaaaaaatgtttttaaaacgtaatatttttaaataattttgtatttttttggtaaatttttttttttattttgtataatgattgttttatatttttttttttttaatatttttaatattatttttagtttatttttagtagatgattttgttttatgttttattgataaaatagatgtatttagatgagattgttttattttttttaatattaaaatttattagtttatttgtatttatttttatatgtttggttttttattttattaaggtgaaagaaggtagtcgggtatagtggtttacgtttgtaattttagtattttgagaggtttaggcgggtggattatttgaggttaggagtttgagattagtttggttaatatggtgaaattttatttttattaaaaatataaaatttagttgggcgtggtggcgtgcgtttgtaattttagttatttaggagtttgaggtaggagaattatttgaatttaggaggtagagattgtagtgagttgagattttgttattgtattttagtttaggcgatagaatgagatttttttttaaaaaaaaaaaaaaaaagatgagaaaaatatttttttttttaaggaaagttatttttttatagttttgtgaagggatgaaaaaaattggatttttttgagtgtatagttaatatttaattttgttttttagtaacgttgttttttatataggttattatgtgtgatgtagttttgaggaaggttgatgaagtaattaagaggtaggggtggatttttaggtggtagttaaaagagtttatttacgtagtattttaaattattggatgaaagttgtaattatataattttaggaatttttttttttgtggttttaatttttattatagttatatgttagggagatattttttatattttagagataaagttagattgttgttaggttagatgttatttttgggtgtggtggtttatgtttgtaattttagtattttgggaggttaaggtaaaaggattgtttgaggttaagagtttgagattaatttgggaaatatagtgagattttgttttaataaaaaatttaaaaattagttagttgtggtggtatatatttgtagtttagttatttggaggttgaggtgtaagggttatttgagtttaggaggttgaggttgtattttagtttggataatagaggtttttttgttttataaaaaaaaaaaaaaaaaaaaaagatgtcggggttgtggtttatgtttgtaatcgtaatattttgggaggttaaggcgggtaattatttgagattgggagtttgagattagtttgattaatatggagaaatttcgtttttattaaaaatataaaattagtttggcgtggtggtttatgtttgtaattttagttattcgggaggttgaggtaggagaatcgtttgaatttaggaggcggtggttgtagtgagtcgagattgcgtttttgtattcgagtttgggtaataagagtaaaatttagttttaaaaaaaagatgttatttttttattgtttttttaaggtttgattttgtggaggggattcgtttatatttttagattaatagttgtagttgttttaattttgttgtgatgattttgtgttgttttttattatgtagtggttggagtagaattaatttatgattgttaaagtaagagttattgtagttttgggttgggagttagtgtttagagttttatttaattgaattgtgtggttttaggtaatttgaattgtttttttgagtttgtttattangtagaatggaaaaattaaataaaaaaattttttttattgttttttttaagtatataaaataaggttttttttatatttgggttgattagattattaaggatagaaatattgttaattttttttttttaagaatattgaggttgggtacgttggtttatgtttgtaattttagtattttgagaggttgaggcgggcggattatttgagattaggattttgagattagtttggttaatatggtgaaattttatttttattaaatagtataaaaattggttagatggggtggtgtgtgtttgtagttttagttattagggaggttgaggtgggagaatttttggaattaaggcggttgaggttgtagtgagtcgagatcgtattattgtattttagtttgggcgataaagattttgttttaaaaaagaaaagaaaagaaaatatttaagttttggtttgaatgtttatgttaattttggttaattaatttattttggaagaatttatttatgttgattaaatttagaagaatataatatataaattatatggttaatttatatatttttatataaaatttttagtggcgtggtcgggtacggtggtttaggtttgtaattttagtattttgggaggacgaggtaggcggattatttgaggttaggagtttgagattagtttaggtaatatggtgaaatttcgtttttattaaaaatataaaaattagttgtgcgtagtggtgtatatttgtagttttagttacgtaggaggttagggtatgagaattgtttgaatttgggaggttgcggttgtagtgagttaagattgtattattgtattttagtttgggtaatagattgagattttattttaaaaaaaaataataataataatttaattgggttgggcgtagtgatttacgtttgtaattttagtattttgggaggttaaggtgagtagattatttgagtttaatagtttaaagattagtttaagtaatatagtaagatttttgtttttatagaagatttaaaaattatttaggtatggtggtttgtatttgtagttttagttatttgggaggttgaaatgagaggattttttgagtttagaaggttgaggttgtagtgaatcgtgattgtattattgtatttttatttgggtaatagagtgagatattattttaaaaaaaaaaaaaaaaaaaaaaatttttgaattgtataatttttttttttttgagatggagaaatacggatgttttttttgnacgagatgtcggtaattttattnggattgatggtttaatagacggtaagtttttttttgtgttgtgatttttttttcgttaattatggatatagttagtttttttggtagtataggaggtttttattttttttttaggtaaaatgtttatttttttttttaatattttttatttttttaaattgtttttttggttaaaggtagagttagattttttgatnttttgttntgtngttttntgnnntttattntttagggtaatattaggggttattttgttttttttttttgtttttagttttacgtttttagttttttttttttaagatgatgatagtatatgtttgaggatttttaagaataagttgtggaaagaggtaagtagatagtttttttttttttttaagatatggtttaggtttggtggttgatagtagttttgttttttttttttattttggttttgggtttttttgtttgggttagataagaggtttattagttgtaggtagtagaggtatagaaggaatgggttttggagatattggatttttgttttgtgtttttatagggttatttgggttatattttaatttatataattagaagtttttttttttttgaggtaatataattttagtaaagatttagtaagtatttgttaagaattgtgttggtattgtaagtttagtttataagattggtttttatcgggcgcggtggtttaggtttgtaattttagtattttgggaggttaaggtaggtggattatttgaggttaggagttcgagattagtttggttaatatggaaatttcgtttttattaaaaatataaaaattagttgggcgtggtggggtggtatatgtttgtagttttagttattcgggaagttgaggtaggagaattatttgaatttaggaggtggaggttgtagagagtcgagatcgcgttattgtattttagtttggttgatagagttagattatgttttaaaaaaaaaaaaaaaaaaaagattggtttttataaagattttaaaggtatattagaaattgagattgaagttgataaataatagtaggatgaggtttagaatttgattttatttgattataatgttttttaggtattttttttttttgtttttgtatttttatattttaaatttttattggaagtttatatttattagttttttttgtggagtgttagtttttttttttttttttgggtaatgtttttttagagttttgaatatatattgttttttagtttttttttttttgatttgggttttagttgtagttttgttataaagtagtagtgtgatgttgggtaagttattttatttttttgggtttttgtttttttatttgtaaaattagggagttggataaattgattttggaggtttttttttgtttggatagtttagaatttttagtaaatttttattcgtgtttttatttttttttgttagtttttttttttatgttatttttttattttttgatatttattttttttgtatttgttttttttgtcgttagtaagagattttaagtagatttggtaaggtttttttgatttttacggttagatattgtgtttatgtgtacgtatatagatatatcgtgttatattagtatagggaagtaggttaggatgaaggaaatatgggagaggggaagtattttgggaggttaaggtggaaggattgtttgagtttaggagtttgagattagtttgagaaatacggtgaaaatttatttttattaaaaatgtagaaattagttaggtataatggtatatatttgtggttttagttatttaggaggttgaggtgggaggattatttgaatttgaaaggttacggttgtagtgagttatgattgtgttatcgtattcgagagtttgggtgatagagtaagattttgttttaaaaaaaaaaaaaaaaaaaaaaancggttaggtgtagtggtttatatttgtaattttaggattttgggaggttgaggtaggtggattatttgaggttaggagttcgaaattagtttggttaatatggtgaaatttttatttttattaaaaatataagtaatagttaggtatggtggtgtatgtttgtaattttagttattttggaggttgaggtaggataattgtttgaatttgggaggcggaagttgcggtgagtcgagattgtattattgtattttagtttgggtaataagagtaaaattcggttttaaaaaaaaagatatgtaaatagataaatatatgaaaagatgcgtaaattattagttattaaggggtcgggcgcggtggtttatatttgtaattttattattttgggaggtcgaggcgggtggattacgaggttaggagatcgagattattttggttaatacggtgaaattttatttttattaaaaatataaaaaaattagtcgggtatggtggcgggcgtttgtagttttagttatttgggaggttgaggtaggagaatggcgtgaattcgggaggtagagtttgtagtgggttgagattatattattgtattttagtttgggggatatagcgagatttcgttttaaaaaaaaaaaaaattattagttattagggaaatgtaaattaaaattatgagatattatggtttataattattattaggatggttgtaaagaaaatataaaattaaaaaattttgaaaatattatgtgttggtgaggatgtggagaggagaaattagaatttttaaacgttgttggtaatgtaaaatggtgtagttattgcggaaaataatttggtagttttttaagaagttaaatatagggtttggtgtngaggtttacgtttgtgattttagtgtttagaagtttaaggtaggaagattgtttgagattaggattttaaggttattttgggtaataaagtaagagtttatttttataaagaattttttttttttttttgagatagagttttattttgttgtttaggttagagagtaatggcgtaattttggtttattgtaatttttagttttacggtttaggtgttgtgtttgtgatcgatagtagcgtttataaagatttgtaaaaatttttattatttaggagttgtattaggaggattatttgaattcgggtagtaggaggttgtggtgagttgagttcgagttattgtattttagtttgggtaataagagtgaaattttattttaaaaaaaaaaaaaaaaaaaaaaggtttatttagatgggaatgatttgaatatatgttataataatttgatttaagtagaaagtagaaagacggaaaaatttgagttatttatttttgatttaaataattttttataaaaggaatataatattgagataaaatttatttttaaattatttgagttaatatgggaaagttttttttttatatttttttttttagtagaaaaaaaatttttcggtcgggtacggtggtttaagtttttaattttagtattttgggaagtagaagtaggtggattatttgaggttaggaggtcgagattattttggttaatatagtgaaattttatttttaataaaaatataaaatttagaagggcgtggtggcgggcgtttgtaattttatttatttaggaggttgaggtaggagaatcgtttgaattcgggagaaggaggttgtagtgagttaagattacgttattgtatattagtttgggtaataagagtaaaatttttgttttaaaaaaagaaaagaagttaagaaaaaaaattttttatatagtaattttttttaaaatttatagattatatagtttattattttagaggaaattaatatattaatattaaaaggtgtattaagattattatataagtcgaatatatttgggggttgggaagaatttgttgatagttagaaaagttagttttataatgcgattatttttttttttaatattttggtattgttgtttttattttagtttttatttaaaagataatatagtatgatttaaaaagagtttgggttggttaggaatagtgatttatatttataattttagtattttaagaggtttaagtaggtagatcgtttgaatttaagagagcgagatttagtttgggtaatatagtgagattttgtttttattttgaagataaaaaattagggcgtggtggtttacgtttgtaattttaatattttgggaggttgaggtgggcgaattataaggttaggagttcgagattagtttggttaatatggtgaaatgttgtttttattaaaaatataaaaagttagttgggcgtggtggtaggtatttgtatttttagttattcgggaggttgaggtaggagaatcgtttgaattcgggaggcggaggttgtagtgagttgagatcgcgttattgagttttagcgtgggcgatagtgagagattttgttttanaaaaaaaaaaaaaaaaggataaaaatatgtaaaaatttaaattaaaaaaagaattaaagttttgaaagaggtaagggttttgttatgttaattagataggagtgtagtggttatttataggtacgattttattaatgtttaaaatgggagttttgatttgttttggtttatttttatttaggtaatttggtggttttttatttttgggaggttattatattgatgttaaatttaatgtagatatttgatcggtttagtgtattatagtttaaaatttttggatttaagtaatttttttattttaatttttttagtagttgggattacgggtatatattattatgtttggattttaaatgtttttgtgagaatcgaagagagtataagaggtagaatttgattattgtttagtataaagtaggtatttagttatagataatgttgatttgttttagttttttatgaaatttagggtatttttgaaaaaggattaatgtttattttgtttattttaaattttattttttttttttttatttatggtaaggtattagtagtttaatgatagagaaagagttttaagtattttttaaatatttaaatatttttagtggaaatgggtttaataaatatttttaaaattttttggtgttattttagtttttatttgttagtgttttagaggttttttaaattttaatagtttttatttttagtggaagttgtgatattatttttttttataaatagagggtattttttgattgttgtgttatttatatttgtattt

SEQ ID NO: 107 - DNA, 6397 bp, Artificial Sequence
  chemically treated genomic DNA (Homo sapiens)
atgtttttataagacgaaatgatttggacgtggatatagagggataattatatgaggatagggagaagatggttatttgtaagttaaggagagaagtttttaagtaaattaatgttgttaatatattgttgttgaatttttagtttttagaacgataaaaaatatttttgttgtttaagttatttagtttgagatattttgttttggtagttttaataaatatattttttaagggtttatttttatttttggtttagtgtattttagttgatgattatagtttaattttttttttttttttggggttttttttttttgtattttttttttttatattttatataggtagatttgtttttgtttttttatttatattacgagtttcgtatagtttttttttttttggtttcggtttttttattaatttttttgttattaacgttattaattcgttaaattatttttttatttttttaaatttttattaattttggtattttataagtgttagttaaataaatgaagaattatattaattttttttttttttttttttattttaaatttttggtgagatttttttgtatttatgttttcgtttttttattttttatttatttgttagtttttttatttttggttttttttattatattgaaatatatttgaaaaagttatgtaagattatagttattgcgtattagtgttatttgagagttaataaagttttttttttttttaagatagcgagtagagtgaatagaagaaagattggtttttgtttttggttgtatagttatgtttcgaggtcgggtttaggattttataatttataaagttaattgtttttttttttttttattttttaggaattgtttgtagtatttgatattgttgagagtttttatattttttaaatttttttttttttggttttttgagttttttttttatttttgatggtattgtaggagtttttaagtattttttttttatattaattttagaaataaagttatttttcgaatttttgtatttagttttttgttttttaattttttgattattaatgttttagaaatatttttttgataattatcgtatttttgtagttgtttttatttttaacgttatgtttttttgagtagtagttttgagtttttaattgtatatttattagttatttttatatggatattttattaaatttgttatattaaatatgtttaaaatatgtatgtttatatgttatatgtatgtttggtatgtgggaatgtattatatttttatagatttttttttagttatagtgttattattttaattatttagattagaatatttagagttatttatgagttttttttttatttaaattgtatatataatttataaataggttttgttgattttattttttaaaaattttttatatgtttttttttatattattggataatagtttagtgtggtggttaatattatgtatattggagttaaatttgttaggtttaaattttgattttttttttatttattaattatgaaattttaggaaaattatttaattttttatttgtaaatatggggattataatggtgatttattttatatgattgataattaaataagtgaatacgtgtatagtaggtattaattatatgtttagtcgatttattttaattttttaattaattagaagaattgtagttttttgtttttttgtatttaagtggggttatggaatgtgggtagaagtgttgtgttatttttatttagaggtaattaaaaagaagatatattttttttatgtttttattgttaatgaatatattatatagattttaattttagaattttttttatattggtatttttaaaatagttttatgagaagggaaatttgtgtagttttaatgatttagtgatgttatggtttgggtatttgttttttttaaattttatgttgaaatgtgattttaattttggaggtggggtttaatgggagatgtttcggttatggaggtggattttttataaatagattgatgttattttttgtaaggaggagaggatgagtgagtttttattgtattagtttttatgagagttggttgttaaaaagtttggtattttttttttttttttcgttatacgatttttttgtatatattattcgtttttgttttttattgagtggaagtagtttgaggtttttattagacgtatatgttggtgttatgttttttgtatagtttgaagattgtgagtttaataaatttttttttattataagttatttagttttgtgtattttgttatagtaatataaatgaattaagataagtgataaatataaaataatttgttttttagataatattgatgtttgaaattttatattgaggtatttttttttttttcgtagtttgataatggtaaatattttttgatattttaggatggatgaatttgtaagagatatttttggaagtaggtttgtatagtgtagagaaaatgttgggtaataaagtaggaatggaggagggttaattagtaagttaaaaagtttttatagttttgtttgttgtgttgtatggaattatatttttttaaaatatatgtttaagttttaattataggtatttgtgaatatgagtttatttggaattaggatttttgtaaatgttattaagttaagatgaggtaatattggattggggtgggttttaaatttaatgattggtgtttttataaaagaaaggtgagggagagttgaatatagcgatataaaggaaatacggggaaggagattatgtgataatgtaggtatagaatggagtgttgtagttaagttaagaatggtaaggattgttggagttattagaagttaggaggaggtaaaggatttttttttagagtttttagagggattatggttttaatggtattttgagtttagaattttaggttttaggattgtgatagaataaattttcgttgtaagttgtttagtcggtggtaaatttttatagtagttttaggaaaatatgtttgtttaatattttattttgaattttaagtttattttatggaattattttgagtttggagtttgatttaattttttttagtaattaacgttttttattttttatttttaaatatgttatattggttttatttttataataattgtatttatttattttttggtaatggggttgttattttttgtagaatgaaaagtagagtgtgtatgtttatattttttttttttttttttttttttttttttttttttttttttttttttttagagtatcgttttgtttcgtttaggttggagtgtagtggcgtaattttggtttattgtaatttttgtttttagggtttaagcgatttttttgttttagtttttggagtagttgggattataggcgttcgttattacgttcggttaatttttttgtattgttagtagagatggggttttattatattggttaggttggttttaaatttttgattttaggggatttattcgttttggttttttaaagtgttgggattataggtgtgagttatcgtattcggtttatagaattttttaaaaagttattgtgtttagtttttatggattttttaaattttagttgtttagtttttcggagttaaatgagattatttaaaggtcgattgttggggtttttaaggtcgtttcggagatttattttataggtaattaaatggatcgttgggtttttgtgtgtgtgggttttttttgtttattttttttttttagaaaaatattttattaagaaggtttttataatttattggaggaggaggatggagagtgggtacgaaaggattaggatgaatatgttataagtaatttaaatgttattgtaatattgtttggtgaggatttgattattgatgttttaaagttaagtttttagttgttattttatttagtagtgaaataatgagttttaaaatatatatttcggtttaagtttttttatgtggggaggtaatttattcgaaggtatttttagtttgtatttaatatagtgtttagtattaaagtagtttagatgttagtgaatggtggttattgggaggtttgttagtgggtgttagtagcggtttttttagagaaaaagaaaatttttttttgttagattagtattttatgagttgtgaattaaaattattgttattattattattataattttatttatagtaattattataaaggtttaataatgttttgtagatgaatattttgagtaattgttttataattaggagatttaagatcgtattaaaaattagtagagggttatattttattgggtataagtcgtttatgataacgaaattgtagtttaatttgtgaagagatgtgaatgtaattgagatacgtttaaatggaatatatagatgagttttatttttatatttggtatgtttggatttatgtcgattttttagttgttcgggtttgtttttaggggttatggatcgtatgattttattagcggtattgttatcgtcgtcgttttcgtgttgtttgcgtttttcgattattgattgggttcggtaggcgttttttgggggtttttttatcggttttagtttttgggattcgggagcgttttgttaggaagttagagtttcgtaggggtcgcggcgtttaggtcgtttaacgcgcgtttttcgttcggcgtttcgaagcggtttcgaggggcgggagtcgaggcgagcggtaaggtcgggtcgggggcgtatagcgtttttagaagtgcgggttttttttattttcggtagcgattttatttttcgttttcgttgcgtgcgcgcgtgtgttcgtttgtttgtatgttttttcgacgttagtgggaatttttagttaggaagtgagagagtgagcgagatagaaagagagagaagtgtattagcgagtcggggtaggaagaggaggtttcgttatcggagcggttcggcgacgcgttgatagttttttttgtttttttcgtcggtcgggtcgttagtcgtcgtagttttcggtttgtacgtagttatcggtttcgttttcggagtttagcgtcgtcgaggtcgtagtcgttcggttagtaaggcggcgtcgtcgttcggttatcgcgcgttttgcgttttttttcgttcgcgttgcggttatggcgcggcgttgattggtttggttcggtttcgtcgcgttttcgttcgtttcgattcgtattcgggttcgttcgggtttcggtttgtcgtcgttttttttttttttagtcggtaggttcgcgtcgtttaggagggagagtttattcgcgttaggaggtcgaacgcggattcgttattcgggtaagttaaattcgggcgagtgggggttcggtaggggacgcgtggtttaagttttgtcgtttagtttttcgtattttttttagttttattcggatttttttatttttgcgttaatcgttgggttagatcgtgggaggaggttgatagtagttgagaggtatatgggattagcgatagcggggaaagatatattcggatttcgtaggggttagtcggtcgaagggtcgcggtcgttcggcggttatttttttttacgttttttcgcggggcgggaacgcgaatcggaggggaatttttataaatttttaaaatttttaattttagttttatttgggggatggtgagaaggttggagtgcgttgcggcgcggaggagagagggaaggtggttggtgtagtgtagaattagattttatttaagggcgttttatgaaatgaaagtagaagtgtttgttagtttttttggttgggaaagttttttttagttttttagaattgaataggagagtttatttattttttttttatttttaaaagaaatttggttcgttttttgtttttttttttttttttttttttttttttcgtgcgcgcgcgcgcgcgtatatatatatatatatatatatatatatatatatacgatatagttatttgttataggatttgattttgatttttcggggtttggtatttgagagagaaaataaattatttatttggatatttagagtattttttagatttgattatgtaaaatttttggatagtgttattatgtattatgtatgatcgttgaaataaaaataatgtaaaaataaggtttattttaaatgtaagtttttttatggtttttaaaaatagatattagggaatgtttgttttgatttgttggtttattttgaaatttaaatgggatttaatgatataggatttaattattaagattgatatgtttatggattttgttaagtagaggtttttagtattatagtttatgaaataatta

SEQ ID NO: 108 - DNA, 6397 bp, Artificial Sequence
  chemically treated genomic DNA (Homo sapiens)
tggttattttataaattgtaatgttgaaaatttttatttaataaagtttatgaatatgttaattttgataattaaattttgtattattaagttttatttgagttttaggataaattagtaagttagggtaaatattttttggtgtttgtttttaaggattatagaaaaatttgtatttaggataggttttgtttttatattatttttgttttagcggttatgtataatgtatggtggtattgtttaagagttttatataattaagtttaaaaagtgttttaagtatttaggtaggtaatttatttttttttttaaatgttaggtttcggaggattagaattaagttttatagtaggtgattatatcgtgtgtgtgtgtgtgtgtgtgtgtgtgtgtgtgtgtgcgcgcgcgcgcgcgtacggagggggggaggggggagagagagagagatagagagcgagttaggttttttttagaagtaggagagggatgaatagatttttttatttaattttggggagttggggagggtttttttagttaagaggattgataagtatttttgtttttattttatggaacgtttttaggtgaaatttggttttgtattgtattaattattttttttttttttttcgcgtcgtagcgtattttaatttttttattattttttaggtggggttggggttggggattttaaaagtttgtaagagttttttttcggttcgcgttttcgtttcgcggagggacgtgaagagaaatgatcgtcgggcggtcgcggtttttcggtcgattagtttttgcgaggttcggatgtgttttttttcgttgtcgttaattttatgtgttttttagttattgttaatttttttttacggtttagtttagcggttagcgtaggaatgaggaagttcgagtggggttggagggggtgcggagggttgggcggtaggatttgggttacgcgttttttgtcgggtttttattcgttcgagtttggtttattcgggtggcgagttcgcgttcggttttttggcgcgggtgggtttttttttttaagcggcgcgggtttgtcggttggagaaggaagaggcggcggtaggtcggagttcgggcgggttcgagtgcgggtcggggcgagcgggagcgcggcggggtcgggttaggttagttagcgtcgcgttatggtcgtagcgcgggcggagggaagcgtagggcgcgcggtggtcgggcggcggcgtcgttttattggtcgggcggttgcggtttcggcggcgttgggtttcgggagcggggtcggtggttgcgtgtaggtcgagggttgcggcggttggcggttcgatcgacgggaagggtaggggaagttgttagcgcgtcgtcgggtcgtttcggtggcgaaattttttttttttgtttcggttcgttggtgtatttttttttttttttgtttcgtttatttttttattttttggttggaaatttttattgacgtcgagagagtatatagatagacggatatacgcgcgtacgtagcgggggcgggaggtagggtcgttgtcgggggtgggggaagttcgtatttttaggggcgttgtgcgttttcggttcggttttgtcgttcgtttcggttttcgtttttcggggtcgtttcggggcgtcgggcgaggggcgcgcgttaggcggtttggacgtcgcggtttttgcggggttttggttttttagtagggcgttttcgaattttaagggttggagtcggtagggaagtttttaggaagcgtttgtcgggtttaattaatggtcggggaacgtaggtagtacggaggcggcggcggtggtagtgtcgttgatagagttatgcggtttatagtttttaagggtaggttcgagtagttggagggtcggtatggatttaagtatgttagatataaaaataaagtttatttgtatattttatttaagcgtgttttagttatatttatatttttttatagattaaattataatttcgttattataaacgatttgtgtttagtaaagtataattttttattggtttttggtgcggttttaaattttttggttatagagtagttatttagaatgtttatttataaggtattgttaggtttttatgataattattgtggatagaattatagtgatggtggtagtaatggttttggtttatagtttataaaatattgatttggtagaggggagttttttttttttttgaagagatcgttattggtatttattgataggttttttagtggttattatttattggtatttgagttgttttagtgttgggtattgtattaggtataggttggggatattttcgggtggattatttttttatataagaaagtttgagtcgaaatatatattttagagtttattgttttattattgggtggagtgataattgaaagtttagttttaaaatattagtaattaggtttttattaggtaatattgtagtggtatttagattgtttatggtatgtttattttagttttttcgtgtttattttttattttttttttttagtaggttataaaaatttttttggtggagtgtttttttggaaaaaaaaaataaataaaaaaaatttatatatataaaaatttagcgatttatttgattgtttatgaggtgagttttcgaggcgattttggaggttttaatagtcgatttttaagtgattttatttagtttcgggaggttgagtagttggaatttagaggatttataaagattgaatataatgattttttaagaaattttgtgagtcgggtgcggtggtttatatttgtaattttagtattttgggaggttaaggcgggtggattttttgaggttaggagtttgagattagtttgattaatatggtgaaattttatttttattaataatataaaaaaattagtcgggcgtggtggcgggcgtttgtaattttagttattttagaggttgaggtaggagaatcgtttgaattttggaggtagaggttgtagtgagttaagattgcgttattgtattttagtttgggcgagatagagcgatattttgagaaagaaagaaagagagagggagggagagagggagggagggagggaggtgtgagtatatatattttattttttattttgtaaggggtggtagttttattattaaaagatagataaatataattgttataagagtagagttagtgtgatatatttgggagtaaaaaatgaagagcgttaattattgaaaaggattaaattaaattttaaatttaaaatgattttataaaatgaatttaaaatttagggtagggtgttgagtaggtatatttttttggggttgttgtaaaaatttattatcgattgaatagtttataacgggaatttattttgttatagttttggagtttaaaattttgaatttaaggtgttattaaggttatgatttttttgaaggttttagggaagaattttttgtttttttttagtttttggtagttttagtaatttttgttatttttggtttggttgtaatattttattttgtgtttatattgttatatggttttttttttcgtgttttttttgtgtcgttatatttaatttttttttattttttttttatgaagatattagttattggatttagagtttattttaatttagtattattttattttaatttgataatatttgtaaagattttagttttaaataaatttatgtttataggtatttgtggttaggatttgaatatatgttttggggggatgtaattttatgtagtatagtaggtaaaattataaaagttttttggtttgttgattaatttttttttatttttgttttgttatttaatattttttttatattgtataaatttgtttttaggaatattttttataaatttatttattttaaggtgttagaaggtatttgttattattaggttacgaagaggaaaaaaatgttttaatgtggaattttagatattaatattgtttaaaagataagttattttgtgtttgttatttgttttagtttatttgtgttgttatggtagaatatataagattaggtagtttataatgaaaagaggtttattaggtttatagtttttagattgtataagaagtatggtattagtatatgcgtttggtgagggttttaggttgtttttatttaatggaaggtaaaggcgggtggtgtgtgtagagagatcgtatggcgagagagaggggagagatgttaaattttttagtaattagtttttataggaattaatgtagtgagaatttatttatttttttttttttgtagggaatagtattaatttatttgtgagggatttatttttatgatcgaaatattttttattaggttttatttttaaaattggggttatattttaatatgaggtttagaggagataaatatttaaattatagtattattaaattattgaaattatataaatttttttttttatgaagttattttggaaatattagtgtggagagaattttgaggttgagatttgtgtagtgtgtttattggtaatgagaatataggaaaagtatgttttttttttaattgtttttgagtaaaggtgatataatatttttgtttatattttatggttttatttagatgtaagagagtagggaattatagtttttttggttggttaggaggttgaaataggtcggttaagtatatggttaatatttgttatatacgtatttatttatttggttgttagttatataaagtggattattattataatttttatatttatagatgaaaagttgaataatttttttaaggttttataattagtaaatagaaggagagttaggatttgaatttaatagatttggttttagtgtgtatgatattaattattatattaaattattatttaatgatataaaaaggagtatgtaagagatttttagaagatgaggttaataggatttgtttatagattatatatgtagtttgagtgagaggaagatttatagatagttttgagtgttttagtttgagtgattagaatagtaatattgtaattgggaaaaaatttgtgggaatgtaatgtatttttatatattaaatatatatgtaatatgtaaatatatatattttagatatgtttagtatgatagatttagtgagatgtttatatggaaatgattaataaatatgtaattgaaaatttaaggttgttgtttagagagatatggcgttggaaatggaaataattgtaaagatgcgatagttgttaggagagtgtttttaaaatattagtggttaaagagttaggagataaggggttaagtataggaattcgaggaatgattttatttttggggttggtatgagagagagatgtttaaaaatttttgtagtgttattaaaagtgggaggaaagtttagaaagttagagaagagagagtttaaagggtatgagagtttttaatagtgttagatattgtagatagtttttaaaggatggagaggggaagagatagttgattttgtgaattataaaattttaagttcggtttcggggtatggttgtgtagttaagggtagaaattagttttttttttgtttattttgttcgttgttttggaggaaaagggaattttattaatttttaaatagtattgatacgtagtggttgtggttttatatgatttttttagatgtgttttaatataatgaggaaaattaagaatgaggagattgataagtgagtgggaaatggggaaacgagggtataagtgtaaaagaattttattaagagtttggagtgagagggaaggaaagaggagttagtgtgattttttatttatttgattaatatttatggagtgttagagttaatggaagtttggaaaggtggagagatagtttaacgagttaatagcgttaataatagaaagattaatgagggagtcggagttagaagaaaggagattgtgcggagttcgtaatgtaggtgaggaggtaggaataaatttgtttgtgtgagatatgaggaggaagagtatagagaagagaggttttaagaagagggggaggattaggttataattattagttgaaatatattaaattaaaaatgagaataaatttttagagaatgtgtttgttagggttgttaaaataaaatattttagattgggtggtttaaataatagaaatattttttatcgttttagagattggaagtttaatagtaatgtgttggtagtattggtttatttgagggtttttttttttggtttgtagatggttattttttttttgtttttatgtggttgtttttttgtgtttacgtttaaattatttcgttttataaggatat

SEQ ID NO: 109 - DNA, 7903 bp, Artificial Sequence
  chemically treated genomic DNA (Homo sapiens)
ttgtttatggcgttattggttttgattggttggtatttgtattttatagataagttattttaatattatttttggtaaatattgagtgttttaggtattgtttgatttttatttatggggtgggatttttttatttagattgagaatagttaggttattgaggtgtattaatttgttaggatataaaaaatattatagatagtataaacgataaatatttatttttttatagttttggagtttggaagtttaagattaagatattggtaggtttgtttttttttgaggtttttttttttagtttatagatggttatttttttattgtggtataaatggttttttttttatatatatttttgttttttttttttttttttttttttttttcgtgtttttagagatagggttttattttgttatttaggtaggagtgtagtggtgtagttatagtttgtggcggttttgaatttttgggtataagtagttttgttattttagttttttaagtagttgggatgataggtgtatgttattatgtttagttaatattttaattttttgtagagatagggttttattatgttgtttaggttggttattggtttttaatttttgggtttaagtgatttttttgttttggtgtttaaatgttgggattataggtgagtattattttgtttggttttttttttttttatgagaataatagttttattggattgtggttttattattatgattttatttaaatttaattatttttttaaaggatttatttttaaatatagttataatgaggattagagcgttaatataagaatttgggggaatatattttattgtgttatataatagaatagattttaaagtatttttttttttagatttttaataaagtgataattagtatagtgtgtatatggttagaggatggggtggaaaatatttgtttggtttttatgatttaaagtgttttaatttgatttttttttttttatatattttatatgttttattttttttttttttttttttgaagtggtaatttattatttgtgtgaaaataatataattttttattgtattttaaaggtatagaaagtttttggtaatgtgtagagtgagttaattaagacgaggggtagtttgtcgggggttgggtgggattgggtagggtgtgatttggttttaaagaattaatttacgttaattatattgggattttgtttttttgtgttttttgttttttttgggttttagttttttgtttttttttttagggaatttttggtttttttttttaggagttaaggtttttggaatagagggtggtaggttagttttttatttttgttttgttttttttgttattgagtgaggtatagatggaagttttatttttagaaaagagaaataaaagtgatttttataatagaaagagaagggttggatgtgttggtttatgtttataattttagtattttgggaggttgaggtgggaggattatttgagtttaggagtttgagattagtttgggtaatatgaagatattttatttttaaaaaaataaaaataaaaaataggcgaatgcggtggtgcgtgtttgtagttttagttatttgggaggtagaggaaagaggatcgtttgagtttaggagattgaggttgtagtgagttgagattgagttattatattttagtttgggtggtagagcgagattttatttaaaaataaataaataaataataataaaaaaaaaatagggaaaaattttaaaatgttttaattttagtaattggagaaaatggaagattaaagattatggtgataaggggagtagatattttattttattttttgagatagggttttattttgttatttagattggagtgtagtggttttattatagtttattgtagttttgattttttgggtttaggtgatttttttgttttagtttttttagtagttgggattatagatgttattatatttggttaatttttgtattttttgtagagatgagattttattatgttgtttaggttggttttaaatttttgggtttaagtaatttttttgttttggttttttaaagtgttgggattataggtttgaggtattgtgtttggttagggatagatatttttaaaatcgtatatttagtttgtgatttagagagaataagagattttagttgagagggtaggaataaaatacgttttataaggtaatattgagtgatttagaatttatttttgttatttttttttagtttttttgattttgcgggtggagggtaagtgtgttattaagtatgtttttggataaggagtttttttgaagatagaagtgatgagaagatagaagaaaaggtaataaggtattaatgaattttaattatattaagattgatgatcgtttggtttttgtttataggaatgttataggaatttttttattttaaaagtaaataataaagtatagttttagttttttttatgtggatataaggtggtagtgattagaaaagataagaatagtgttgtgttttagtataaaaacgtaattatgttatgtaatatggtagttattaattatatgtgattatcgagaagttataatgtaattagtatgattaggtaattgaattatttttattatattttattttaattaattttattatttttaaatagttatatatggttagtgttttttgttttgaatagtgtgggatttattggtattgataggttggatatatttttagtttttattttgatttaatttatggttaggtgagtttagaaagaataaaagagaaagagataatggagattaattataatagttagtatttaatgtgtgtttattatatatttaggtatttatttaaatatgtaaaaggtattttgtataatttttgtaaaaatattaagattattgttattttatagatgaaaaaattgaagtataataagaattttatttgtttagaattatacgagtaaataaggggtgaagatggtatttatatataggtagttttattagagtttatttatttatattatatagatttaggaatgaggtggtatggagtgattggggttatggtttttaaattgtgttaaagtataagtttataagggtattgtggaatatttttaatttttagaggaaatatagtaatattttatattttttaaatattgtgtgatttattaatttgaggtgatttatagttggaatattagattgtgttatattttttttgatgataatatatttggttaggtgtggtagtttatgtttatatttttagtattttgagaggtcgaggtgggtagattagttgaagttaggagtttaaggttagtttggttaatatggtaaaatttcgtttttattaaaaatataaaaattagttaggtatggtggtaggtatttgtaattttagttattcgggaggttgaggtaaaagaatggtttaaatttaggtagtagagattgtagtgaggtaagatcgtgttattgtattttagtttgggttatagagtgaaattttgttttaaaaatatatatatatataaagataatatatttttataaaagatggttttagaaggtttttttgataaaaattaagtattaagtaaaaaaaaaaagtattgtgtaaaaattagtatggaatagaaaatgagggtggtagtattggatttttgtatgtgagaagttgagtagtgttaaatagatgtatatatttcgtaagtaattgtttgtggttatttaagaacgaaattttttttttaatttgtgtgtattgttatttttaaagtgttagtaagtttttaggaattagttatttattttgttgtttaggttggagtgtaatggtgtgattttaggttattgtaatttttatttttcgggtttaagttattttttttgttttagttttttaagtagttgggattataggcgtttgttattacgtttagttaattttttgtatttttagtatagatggggttttgttttgttggttaggttggttttcgatatttgattttaggtgatttatttatttcggttttttaaagtgttgggattatcggcgtgagttatcgcgtttggtttttatatataaatttttttttaattttttaaattaaaaattaaatgtaaatttaatgtaaaaatgtaaattaaatgtaaaaattaaattgtaaatgtgggtagaagtaatagttgtattttattaaagatacgttatttatgttatattttggtattcgtgtatttcgataatagaatttttttcgtgggaggagttttttagttatttgaattgtttggattaatattgcgtagattaagggattatttgtgtttttatttattaaatttatttttattttttttgtcggtatttaggatttcggaatttttgtttgagaatttttttttttttcggtttgggtttggatgtgtttttttaaattttgtattttttaagttagtattgttgtcgggggcgatttagttttttttgtttagggagtaatttagatatagtttcgttttatttttattttggggttgtataatttaaggtatgaaattttttttttttgaattttttacggtttgttattgatatagttggaatgaggttgtaaggagagggttgggggtttttttttttatttttagttttattttcgtataggtttttttgttgggaatttttgttttgcggattggaatgggtatcgagatgaaatgttgggtgcgtttcggtttttttcgttcgtttcggggtagaaggtttagggttgggaagaattttgattaggtttatagtttaggtttagtcgattgaattagggtgtgttattatggagatagggtcggttcgcgtgttcgtttgttattggttggggattttagggtaagggatataagttagagtttagattagtgagttaattgtgcgaattagattcggtagttttgtttagtttagtatagcggagcggattcgatcggatcggagcggatcggagtatatcggagtaggtttatcgagaaggcgtttgcgagattatggagaacgggtgaggagggtattaggttcgtaggatttttggggaggggtaggtgttgtgattcgggaatttggtatattgggtttagagggagttggcggagggagcgagcgtttaggggatgtagagaggtttggtattgagtttagtgtcgggagtaaggcggtagagttatgcggtagttagcgcgggtagggacgtacgcgggaatcgagttggggtggcgttatcggagtaggaaggggataggtcggtgcggtttaagttatttcgtaaaagtagtcgttgtgtgttttcgtgtgtgtgttaggggaataagtggagagtgagtatatgtatatattttttattttatattaggaggaggtttttttattttttgcgttttttataaatttttatgttagggtttgggtaaagttgcgaggtatttttggtgtttaaattcggagttttttttttagaggtaagattatttattttttttgttagttgtattttttttttttttttagattggtagtatgattaattcggtgggaagtgattgttaagtggagacggaaattagttatcgaattgagtaatagttttgtgtttattttttttattttacgtttttgaaaatttttttttcggtttgggttttggatattttagtttaagtgatttgtattaggtattatagttgtttttggatgtttagggagttagggtgtttttgaggggattgatagttaatgaggaagtgttgtgagatgtggttagatatgttatgtggcggtagttttatatatttattttttttgtattttttggggatgttatttgattaatattttattagtttaattgtttttttttattgttttgtggtttcgttgattagtttttaatttatttgatttaattgtttttttgagggtagtttggtgtattgtgtaattatgtttggtttttcgggttttgttttttaagtaaaaaattttttgtgaaagtttggttagttgtgtttagttttgttatattttattgttatttttgaaagtaacgtttggtttttttagatggatgtgagagaattggatttggaattgggagaaaagtaatacgggttgatttttgttagtgtaggggttttgggtaagtgttttgaggtttttgaagagtaaagattttcggtggagagaaaggaaattgggaggaggtagggagggggaaggataggaagaagattataggtaggtggaaagtaggagaaagatttaaatattttgtgtaatagagttataggtttttggaagttgttagtaagtatttaatttatttttagattgagtttataagatagatggggttaatttatattttttgtttatatttgagaaaataatttaaagtataaattatatgtttaaaaagataatattgggattagaatttaggtcgaattttgtttttttttagattagtaatttttaaatttggttttattttattttatttttatttatttattttggagtcggagtttcgttttgttttttaggttggagtttagtggagcgattttggtttattgtaatttttgtttttcgggtttatattattttattgttttagtttttcgtgtagttaggattataggggttcgttattacgttcggttaatttttttttttttttttttttttttgtatttttagtagagacggggttttaatatgttagttaggatggtttcgattttttgatttcgtgattcgtttatttcggttttttaaagtgttggggttataggtatgagttatcgcgtttagtttttaaatttggttttaaaattaaaattatatgggttttagaatttgttttttgtgggggttttgtgtgtgtgtgtgtgtgtgttttttatagggttttattttgttattaggttggagtgttagaatttgtttttttaataagtttttgttgagaatttgtgtagttagttttggtttaatttttgataattagtattgtggattgggtttgtttttttgtatagtagtttatttagttttttgtttggaattaatttttttgtgatttagggagttaagaatggtacgtagatttttattaggggtggttttattgtgttttattggttaaaataaaaaagaaatgtagtttttaagtttttggttgaggaaggaattggaggaatgagggtttaaaaggaaatttgagtttatttttgtttttatagtagttggttttaattatattttgaatgtttttggggaataggtaaggtaataagggggattttattaggtgggtattatttttaggaagggtttaattttattttgagtattttttttgggtttttttttggttaagtttttttattttttttaatttgattatttttttgtattttttcgtatattttggtttttttttttttaaatttttgttataaggataagtatgtagtttgttagtgtttagtggatttaatattggagttgggtttgttagtagaaataggttttattaatttttgttaggttttagaatggaggtagttttatattagatttgtagtgggtttgatttagaaagaagggtggttgagtagatggaagagtatagtatggtttttttttttgtgttagttttttcgtttttgttgttttagtatatttgttagtttttttgtatcgaaggttatttgtttgtgatgtttttggaatgggagtagaatttattttgatatttttttttttttaga

SEQ ID NO: 110 - DNA, 7903 bp, Artificial Sequence
  chemically treated genomic DNA (Homo sapiens)
tttgggggagaaaaaatattaaggtgaattttgtttttattttaagggtattatagataaatgattttcggtgtaaaaaggttggtaggtatattgaggtagtagggacggagaagttggtatagagggaaaggttatattatgtttttttatttatttagttatttttttttttgaattaagtttattataagtttgatatgaaattatttttattttagagtttggtaaaagttaataaagtttgtttttattaataggtttaattttagtgttggatttattgaatattggtaagttgtatatttatttttatgataaaggtttagagaggaaggggttagagtgtacggggaagtgtaaggaaataattaaattagggagggtaaaagggtttggttaggagggagtttaagaagagtatttaaaatgggattaagttttttttgagggtggtgtttatttagtaaaattttttttattattttatttgttttttaaagatatttaaaatgtaattaagattaattattatgaaggtagagataaatttaaatttttttttgaatttttatttttttagttttttttttagttaaagatttaagggttatattttttttttgttttaattaataaaatataatgggattatttttggtagaggtttacgtgttatttttagttttttggattataagggggttaattttagataaaaaattagataaattgttgtataaaaaagtagatttagtttatagtattggttgttaaaggttaaattaggattgattatataaatttttagtagaagtttgttagaaaaatagattttggtattttagtttggtgatagagtgagattttataaaaaatatatatatatatatatataaaatttttataaaaaatagattttgaagtttatgtaattttgattttaaaattaggtttaggggttgggcgcggtggtttatgtttgtaattttagtattttgggaggtcgaggtgggcggattacgaggttaggagatcgagattattttggttaatatgttgaaatttcgtttttattaaaaatataaaaaaaaaaaaaaaaaaaaaaaaattagtcgggcgtggtggcgggtttttgtagttttagttatacgggaggttgaggtagtagaatggtgtgaattcgggaggtagaggttgtagtgagttaagatcgttttattgaattttagtttgggagatagagcgagatttcgattttaaaataaataaataaaaataaaataaaataaaattaggtttaggaattgttggtttggagggaagtagaattcgatttagattttagttttaatattgtttttttaggtatgtaatttgtgttttaaattatttttttaggtataaataagggatgtaaattggttttatttattttataggtttaatttgaaaatgaattgaatatttgttaataatttttaaagatttatggttttgttatataaagtatttgaattttttttttgttttttatttgtttgtggttttttttttgtttttttttttttttgtttttttttagttttttttttttttatcgaggatttttgttttttagaaattttagggtatttatttagaatttttatattagtaagaattaattcgtgttattttttttttagttttaagtttagtttttttatatttatttgggaagattaaacgttgtttttagaggtggtaatgaggtgtgatagagttgaatataattaattaagtttttataggaaattttttatttggaaagtagagttcgggaaattagatatgattgtataatatattaggttatttttagggaagtagttggattaggtaggttgggggttggttaacggagttataggataatggagagaagtaattaagttggtaaaatgttaattaaatggtatttttaaaaggtgtaaaggaaatgaatgtgtgaagttgtcgttatatggtatgtttagttatattttatagtatttttttattggttattagtttttttaagaatattttggttttttgggtatttaaaagtaattgtgatgtttaatgtaggttatttggattgggatatttaggatttaagtcgagagaagagtttttaaaggcgtggggtgggggaagtgagtataggattgttgtttagttcggtgattgattttcgtttttatttagtagttattttttatcgagttaattatattgttagtttggaaggaagggaggagtgtaattggtaaaggaggtgagtaattttgtttttaaaggaggaatttcgaatttgagtattaaaagtatttcgtagttttatttagattttagtatgggaatttatgaagagcgtagggggtgaggagatttttttttggtatggagtgagggatatatatatatatttattttttatttgtttttttaatatatatacggagatatataacggttgtttttacggagtagtttagatcgtatcgatttgttttttttttgtttcggtggcgttattttagttcgattttcgcgtgcgtttttgttcgcgttggttgtcgtatgattttgtcgttttgttttcgatattaggtttagtgttaggtttttttgtattttttgggcgttcgtttttttcgttagttttttttgggtttagtgtgttaggttttcgggttatagtatttgtttttttttaagggttttgcgggtttggtgttttttttattcgttttttatggtttcgtagacgttttttcgatgagtttgtttcggtgtgtttcgattcgtttcgattcgatcggattcgtttcgttatgttgaattgagtaaggttgtcgggtttggttcgtatagttggtttattggtttaggttttggtttatattttttgttttggagtttttagttaatggtaagcgagtacgcgggtcggttttgtttttatggtgatatattttaatttaatcggttgaatttgggttgtaaatttaattagagttttttttagttttaaattttttgtttcggggcgggcggggggagtcggagcgtatttagtattttatttcggtatttattttagttcgtagggtaggagtttttagtaagaaggtttatgcggaaatagggttagaagtagggaggagagtttttagttttttttttgtaattttattttagttgtgttaatagtaaatcgtgagagatttaaaaaggaaaaattttatattttagattgtataattttagaataaaaatgaagcgagattgtgtttgagttgttttttggataagggaagttgggtcgttttcggtaatagtgttaatttggaggatatagggtttaggagagtatatttaggtttagatcgggagaagaaaaagtttttaggtaagaatttcggggttttagatgtcgatagaaaggataaggatggatttggtgggtagggatatagataattttttgatttgcgtaatattgatttaagtaatttaggtaattagaggattttttttacgaagaaaattttgttatcggaatatacgggtattagaatataatataaatagcgtgtttttggtagaatataattattatttttgtttatatttataatttaatttttatatttaatttatatttttatattaaatttatatttaatttttaatttaaaaaattaaaaaaaaatttatatataaaggttaggcgcggtggtttacgtcggtaattttagtattttgggaggtcgaggtgggtggattatttgaggttaggtgtcggagattagtttggttaataaggtaaaattttatttgtattaaaaatataaaaaattagttgggcgtggtggtaggcgtttgtaattttagttatttgggaggttgaggtagggagaatggtttgaattcgggaggtggaggttgtagtgatttgagattatattattgtattttagtttgggtaatagagtgagtagttggtttttgagaatttattagtattttgaaaataataatgtatataaattgaaaaaaaaatttcgtttttaaataattataaatagttatttacgggatatgtatatttgtttggtattatttaattttttatatgtaggaatttaatgttgttatttttattttttgttttatgttgatttttatatagtattttttttttttatttaatatttaatttttattagagggattttttaaaattattttttgtaaagatatgttgtttttatatatatatatatttttgagatagggttttattttgtaatttaggttggagtatagtagtacgattttgttttattgtaatttttgttgtttgggtttgagttatttttttgttttagtttttcgagtagttgggattataggtgtttgttattatgtttggttaatttttgtatttttagtagagacggggttttgttatattggttaagttggttttgaatttttgattttaattgatttgtttatttcggttttttaaagtgttgagagtataggtatgagttattatatttggttagatatattgttattaaaaggaatgtagtataatttaatgttttaattgtgaattattttaagttaataggttatatagtgtttaagaaatataaaatattgttgtgttttttttgaaaattaaaaatattttataatatttttgtgagtttgtattttggtatagtttgggaattatggttttagttattttatgttattttatttttgaatttatgtagtgtaaatgaatgggttttaataaaattatttgtgtatgaatgttatttttattttttatttattcgtgtgattttaggtaagtaaaatttttattatgttttaatttttttatttgtaaaatagtaataattttagtatttttgtaaggattatatagaatattttttatatgtttaggtaaatgtttggatatataataagtatatattaaatgttggttattatgattaatttttattgttttttttttttttgttttttttagatttatttaattataaattgaattaaaataaaaattagaggtatatttagtttattaatattaatgaattttatattgtttaaaatagaaggtattagttatgtgtggttatttaaaagtaataaaattaattaagatgaaatataataaaaataatttagttatttaattatattaattatattgtaatttttcgatagttatatgtggttagtggttattatattgtatagtataattacgtttttatgttagagtatagtattgtttttattttttttagttattgttattttgtatttatataaaagaaattggaattgtgttttattatttatttttagggtaaaagagtttttgtagtatttttatagataggaattagacgattattaattttagtgtgattagagtttattaatgttttattatttttttttttatttttttattatttttatttttagagggattttttgtttaggaatatatttagtaatatatttattttttattcgtaagattaaggaaattaaaaaaaagtggtaggaataggttttaagttatttagtattgttttgtggaacgtattttatttttgtttttttaattgagattttttattttttttagattataagttaaatatgcggttttaaaaatatttatttttggttaggtatagtgttttagatttgtaattttagtattttgggaagttaagataggaggattatttgagtttaggagtttgagattagtttgagtaatatggtgaagttttatttttataaaaaatataaaaattagttaggtgtggtggtatttgtggttttagttattagggaggttgaggtaggagaattatttgagtttaggaagttaaggttgtagtgagttgtgatggagttattgtattttagtttgagtgatagagtgagattttattttaaaaaataaaataaaatatttattttttttattattataatttttggttttttattttttttaattattgaaattaaaatattttagggtttttttttgttttttttttgttgttgtttgtttgtttgtttttagatagggtttcgttttgttatttaggttggagtgtagtggtttaattttagtttattgtagttttaattttttaggtttaagcgatttttttttttttgttttttaagtagttaggattataggtacgtattatcgtattcgtttattttttatttttatttttttagagatggggtatttttatgttgtttaggttggttttaaatttttgggtttaagtgatttttttattttagttttttaaagtattgggattatgggtatgaattagtatatttagtttttttttttttgttatagggattatttttattttttttttttaagagtgagatttttatttgtgttttatttagtggtaggaagaatagagtagagataaaggattggtttattattttttattttaaagattttggtttttagaaagggaagttaggaattttttaaaggaaagagtaaagaattgaggtttaggaagagtaaggagtataagggagtaaagttttaatgtaattaacgtaaattaattttttaaaattaggttatattttatttaattttatttaattttcggtaaattatttttcgttttagttaatttattttgtatattattagaaattttttgtgtttttgaaatgtagtaagggattgtgttgtttttatataggtggtaaattattattttaggaaagaggaaaaaagaaatagggtatgtggaatatgtgaaaaaaaagaaattagattgggatattttgggttatagaagttaagtagatgttttttattttattttttggttatgtatatattgtattagttattattttgttggaaatttaaagaaaaaaatgttttgaaatttattttattatataatataatgaagtgtgtttttttaaatttttatattgacgttttaatttttattgtgattatatttggagataagttttttaaaaaggtaattaagtttaaatgaggttataatggtggggttataatttaataagattgttgtttttataagaagaagagaggttaggtagggtggtgtttatttgtaattttagtatttggatattaaagtaagaggattatttgagtttaggagttagagattaatgattagtttgggtaatatagtgagattttgtttttataaaaaattaaaatattagttaggtatggtggtatgtatttgttattttagttatttgggagattgaggtggtaggattgtttgtgtttaggagtttaaggtcgttatagattatgattgtattattgtatttttgtttgggtgatagagtgagattttgtttttaaaagtacggaaaaagaagagaaagaggaagagaaagtaaaaatgtgtgtagagaaaaggttatttatgttatagtgagaaggtggttatttgtaagttaaggagagaagttttaggagaaagtaaatttgttaatattttgattttgggtttttagattttagagttgtgagaaaataaatgtttgtcgtttatgttatttatagtgttttttatgttttagtaaattaatatattttaatagtttaattgtttttaatttaagtgagaagattttattttataggtaaaaattaggtaatatttgagatatttaatatttattagagataatattaaaatggtttatttgtaaaatataggtattaattaattagaattaatggcgttataaataa

SEQ ID NO: 111 - DNA, 6534 bp, Artificial Sequence
  chemically treated genomic DNA (Homo sapiens)
tttgattcgagcgaaagaaagatttgttagttttttttttttagtattttttttttttaagagtaggatatatagttttagttttttatgtatcggcgttcggaggtaggagtttttggagtggttattcgtttatttttttgttttacgagttaaggaaattaacggattttaaggttttttttatttattttttttagttttgttttcgtttttattttatttatagtttttatttgttttcgtatagattagattttttggtttttttaaggtttaggttgttcgtttttaatataagacggttttttagttaaataaggttttttaatttttattttttttatatatattagatttttttatatatatatatatatatatttcgaatatatatatttcgaatatatatatttcgaatatatatattaaagagtagttatcgaagaatttgttttttaaatattatttttattttattatgaatttttatttaattgagtagaatattttttggaagattagataggatttatttattttttataagatattttatttttttcgttttggagaatcgggcggcggaattttgttttttttgtttgtttaaaaataatttttttagatttaaatgaattaggatattagttgttgtgagatttattttttttttttttttttattgtttttaaaaaaaaaagtatttttttttttttttttttttttttttttttttttttattttttttttttttttttatttttttataaattatatgttttttattgtaaattcgtttatacgttttttggggtttttttagttgaaggagtaaatttatttcggttggtttatattatgttttaatgggatgtttatatttttatttagttttttaattcgaatttatttcgattgatttttcgatggggagaagagcggcgttaatgtttttgataaataattgcggggggtttaatgattgttattgaggtagcggttgcgaaggattacgggtttaattcgggtatttattaattttgtattattatattcggatcggaagtttatgattacgaatttggcgttttgatgtttttttcgtgagttttcggtagtttttttgtgggattgagggtttttcggcgtttgtttaatttttattgtattttgagaattacgtttggggtcgggcgggtggttaggaatttttttgttcgatcgtgttagtttgttagagttcggttttttagacgggaggaaaaaggtttgggtggtagatattattttcgttttttattaggttagggatattattttgtatagattataatttttttttaagatttgtgtttggttgagtatgaagttaatttttagaggttttgagaagtttacgggttatgaaatttttgtgttagtgtttttaagtgcggaggttgttcgttaaagggtgttttatagtttaggtcggttattaaagtgcgattgggttgtagacgtacgtatttaaacgggttgcgagggagaatttttaagttaataagggtacgttttatttaggtttggatagttagttcgttgttatttttatttgtagtgtttttgaaattgggggtagaggcgtagaggggataatagaagttatttttttcgtttattttttttttttttttgttaaattatttaaatatcgtttttaaggttttcgttttatttcgaacgtgtatagagcgtgagtggattttatattcgtttataatatcgttgtggagagttttattgatgttttttgggtaatttgttagtttaggtaaaagttattgttttttaaattagggtttaaggatgtagggcgcgggttttcgttttttaagttttatcgttgggttatttttttattaattagcgtttgtatcgcggttaaatttggtattaggattttttggtttatcggttgcggatagggaagtggtttggatttttatttagttgcggggtttgggtgtggggtggtttgggtttcggagagattttagaaagaaataaaggggaggtttaagattcggagatagagaaagagtggttggaattattcggtatttttgagatttgttgcgttttgttttgcggagttacggttttgagtcgggttaggtttggcggcgtgcgggcgttttaggttaggtagttttagttaattttgttgttttggttattttaggtcggatttcggggatataggttataagaaatttagatttattaagtttttggatgtggtttagttgtttagagtttaagggtgtttttttattttttttcgggtgtttagggatttttggttattggtcggtgagaagggtcgggttgattatttgggtatatatgaattttagagcgttcggtagaaaagaaagaggtcggaaaggagagaaaatgagtcgttttttgatttcggagttttaggtttttagtatttttatatttttgtggtttttatttgtatatgtttatagtaagtgatagttagtttatgaatttatgggtatttaagatttagtttagtcggtagtattttcgtttaacggtttcgcggattttgtaatttacgggatcgggagaaggaattttgtagtaagcgtttttttttagtatttgtcggtttttaggagagaaaattttcggtaggagagagacgggtggacgttgggagggtttggagattaagttttcggtttaaaaataaatgagatttagttttagatgttttttaattgttcgcggggtttaagagtttattttagttgagagttgagtttatttttgtttttttgaaattatatttttggtattttttttatatagtaattatcgttgattttagaaagtgttttgtcgattttgtttaatttttgggaagaagaaaatttggaaaaagtttagtttttaaaatgttatcgttgagaagtggtttaaaacgtacggatataggttttggtggttttaacgttttaaaaagaaaatgagaaaattttttttttgaaaaattgaattatttaatgtaaaattaggttaaataaggtatatgttttttttatgggtttagatatttttgggagttttttgagatttgttttcgtggttttgagggttaattaagttttttggtattaggtaggttgaaagtttgtttggtttttttaatggtgagtgggtttttaaagggttaatttgtggattgttgagcggttatattttatatttttttatattttgttttttgagtttgttttaattagggaatggggaagtagggttgggggttcgagtttacgttaaaattgttaaaggaggtgggggagggggatagagagagaggagtggagaattttttttaggggtaggaaaaatttaaaaattataaaaggaaaagggggaatttgaagtttagaagttattgttttttttattttaaagggaaaaatttgttcgatttttatttttttgattgattaaggttttgaatatttcgcggtttcggagtgatagtttttgaataggttcgagcgaataaagcgtagtgtagagcgcggggttggtattcgggggtgtaaaggaggcgagttcgttggtatttattaagttataaataaaaggttatgtataatggtattttttttaaggatagatagtttttataatatttttggcgttatattttgttggggatattttagtttttagttaagatttcgttttttttatttttttagtagtttagtttgaatgttataataaatttttgagaataaacgttgaattcgggtaaaattttaatatatagatatatttttgtcgacgtatcggggatttatatgtagagatttagaatcgtagtttgttagagcggtttttatattaagaagaggagttaggtttttttttgtatttttttttatatttttagtttttaattaacgagtgtttgggtttagcgacggttgtttgtgttttatattagtttcgtttgcggacggagaagataaaagaatattagcgtattttggattttttttaggaggagttttatcgggaggattttttaataagtttaggttaaggggtattgattataggaaggaaagttaaatatgtttggggttttagatgtttttttattggaattgtgttttttttagtggtagtaagttaagagaaatgagagcgagatttataggtagaaaaaatgagatatagagagagatataggaaattataagaggaatagaggttgagcgagatatatatatagaggtatagaaagagatagagagggaaatagaaagttaaggaaagagtgattagagaaagatatatatatatatatatatatatatatatatatatatatatatatatatagagtgatatagatagagagatagagatagagagataggaattttttcgtttttagtaattgttatttttttggggttgttttttttagtttttatcgggttaatttttttttttgggtaaggggcgtagcgcgggtttttttcggggttagtagaggtttcggtattattagagatgggaagagaaagtggtcgttgttgtttaattagcgcgtgttttcgttattcgggacggtttattcgtcggttaatcgtagtttagggtttttgattaagttttgggtaaaagaattaataaatgttttcgagttcggattttcgtattcggtgttattataggaggagatttaggtaggtcgcgttttagttttattaggtttttcggttcgtcgtggttttttgagttttttttttagggattttagtcgttggaatatttgtttagattcgtattaaattttttcgttttgggttcgggattttggatttcggggttttttcgtttttttttttttcgggttttagtttcggtttttggattaggaatcgatagttttttttttcgcgtttttttttttttttttagtcgttttggggaggggttttttacgtttcggatagttttcgagggttattcgcgtcgtattcgttttttcgtttcgtttttatttggatataattttcgagcgaagttgtttttaggatgattacgttggtcggcgttgtgtttaggatgatgcggtcgggttcggggtagaattattcgcgtagcgggttttcgttggaaggtaagggagggttttagcgcgtcgtttggattttagggtttgggatcggttgttttattttatttttaggtttcgtaggtttttttggtgtttttaggaagtttattttttgggtattttatattttaagaagtattagtcgggggcgaggatttattcgattttttttttgtaaatggagcgcgttgttttttgtaaattttggcggagttgggcggttaggtttgcggcgagtcggggagatttgtttttgttgttttggaaatgtcgcggtggagaaggaggtgaatcggtttttgagcggtagaagtaattttttcgtaatttgtttattcgaaattgtttcgaagttgtttcgaaattgtttcggttgcgtttatatttgtgaaatatatgttagtttaggaagtatttttttttttttgttttgtaaagttgtggtggttaacgtcgcgttattgtgattggaatttttagaataattaaataaattagaattttatgtattttaaatagtatttagaagtttttataatttgtttaggaatcgttttttcgtttatttgaagattttgggaatttcggggaggtaggaagttttgtaagtttgagtcgtttttaatggttttttaggttagggcgttttagtagagatgtttatcgttttcgttatttattttttttatatttagtttagagtagaatgtaatatttagagtaagaatgggggttgggggtttaggaatagttttgtcgttgttgtggtttttgttttaagatgtaataggtgatataggtattgttgtttgggttttttttttggattttttttgatttttggttgttgtatttttggttagaaattttaagggttattagttggtttaagttttttagaaagggagagattttaattggatagggatcggtgggagtagagtttattaaggttagtttttgggtgaattttttttcgttaggaggttgtttttagagtaagttagattttttattagttgtagggttttttaagttgttatttttcgggttcgaaggggaagacgttttttttggggagaattattttgttttatttgttgtttttatataagattatatgcgttatattgttgaataatttgaataaatgtgattgaaaggaggtttgggtttgggagttcgatgtcgagtagttttagcgtcggtgttgtaatatgaggataggatagaagattgcgaaattacgtgttgttgttttttgttttttatttttttttagtgattttttttttgttttttttttttatttttttatagt

SEQ ID NO: 112 - DNA, 6534 bp, Artificial Sequence
  chemically treated genomic DNA (Homo sapiens)
attgtgggaaggtgaaaaagagaagtaagggaaaagttattggaggaaaataaaaagtaaagaatagtagtacgtaatttcgtagttttttgttttatttttatgttatagtatcgacgttgaaattgttcgatatcggatttttagatttagatttttttttaattatatttgtttaaattatttagtaatatagcgtatgtaattttgtgtaaagatagtaaatggggtaaaataattttttttagagaaagcgttttttttttcgggttcggggagtggtaatttaggagattttgtagttggtagagagtttagtttgttttagaaatagttttttggcgaagagaagtttatttaggagttggttttgatgaattttgtttttatcgatttttgtttaattgggatttttttttttttaagggatttgggttagttgatagtttttggggtttttagttaaaagtgtagtagttaagggttaaagagggtttagaaaggaggtttaagtagtagtgtttgtgttatttgttatattttgggatagagattatagtagcggtagggttgtttttgggtttttagtttttatttttgttttgggtgttatattttattttaggttgggtgtgaagggagtgggtggcgggggcgatgagtatttttgttggggcgttttaatttggaaaattattgaaaacggtttaggtttgtaagattttttgttttttcgggatttttagaatttttaagtggacggaaaggcgatttttaaataagttatagaaatttttagatgttatttgagatatatagaattttaatttatttaattattttaaaaattttaattataatggcgcggcgttagttattataattttgtagggtaaaaaaaaaaaaatattttttgaattaatatatgttttataagtgtgggcgtagtcgggataatttcgagataatttcgagataatttcgaatggataaattgcggagaagttgtttttgtcgtttagaagtcggtttatttttttttttatcgcggtatttttaaaataatagggataagttttttcggttcgtcgtaggtttgatcgtttagtttcgttaggatttgtagagagtagcgcgttttatttgtagaaaggaaatcgagtaggttttcgttttcgattggtgttttttggggtgtggggtgtttagggaatgggttttttggaagtattaaaggagtttgcggagtttggggatggggtgaggtagtcggttttaggttttgggatttaggcggcgcgttgaggtttttttttattttttagcgggaattcgttacgcgggtagttttgtttcgggttcggtcgtattattttgggtatagcgtcggttagcgtggttattttgggggtagtttcgttcggaaattatatttaggtgaaggcgaaacggaaaggcgagtgcggcgcggatgattttcgggaattattcggagcgtggagagtttttttttaaaacggttggagagagagggagggacgcggggaggggggttgtcggtttttagtttagaggtcggagttggaattcgggaaaggggaggacggggaggtttcggagtttaggatttcgagtttagggcggaaaagtttggtacgagtttgggtaaatgttttagcgattggggtttttgaaaagggggtttagagagttacggcgagtcggggagtttggtgaggttggagcgcggtttgtttgagtttttttttgtggtgatatcgagtgcggggattcgggttcgggagtatttattagtttttttatttaaagtttggttaggagttttgagttgcgattggtcgacgggtagatcgtttcgggtggcggagatacgcgttgattgggtaatagcgattattttttttttttatttttggtggtgtcgaggtttttgttggtttcgagggggattcgcgttgcgttttttgtttaggagagaaggttggttcggtggaaattgagagagatagttttagggagatggtagttgttgagggcggagaagtttttgtttttttgtttttgtttttttgtttgtgttattttgtgtgtgtgtgtgtgtgtgtgtgtgtgtgtgtgtgtgtgtgtgtgtgtgtttttttttgattattttttttttgattttttatttttttttttgtttttttttgtgtttttgtgtgtgtgtttcgtttagtttttattttttttgtgattttttgtgtttttttttatgttttattttttttatttgtaggtttcgtttttattttttttggtttattgttattggagggggtataattttaataagaaggtatttggggttttagatatatttagtttttttttttgtggttagtgttttttggtttaggtttgttaaggggttttttcgatggggttttttttgggaggagtttagggtgcgttgatgtttttttgtttttttcgttcgtaagcggggttaatgtgaagtataggtagtcgtcgttaggtttaagtattcgttagttgaaggttgggggtatgggggagggtgtagaaaaaaatttggtttttttttttggtgtaaaaatcgttttggtaagttgcggttttaaatttttatatatagattttcgatgcgtcgatagagatgtgtttgtatgttaaagttttgttcgggtttagcgtttgtttttaggaatttattatggtatttagattaaattgttggaaaaataaaaggaacgaagttttggttaggagttgaagtgtttttagtaggatatgacgttaggagtgttgtaaagattgtttgtttttagagaaggtattattgtgtatagttttttatttataatttggtaagtgttagcgaattcgttttttttatattttcgagtgttagtttcgcgttttgtattgcgttttattcgttcgagtttatttagggattgttatttcggggtcgcgaggtatttagggttttaattaattaaaaggatgagaatcgggtaggtttttttttttgaaataaaggaaataatgatttttgggttttaagtttttttttttttttttatgatttttgaattttttttgtttttggagggagttttttatttttttttttttgttttttttttttattttttttgatagttttgacgtgaattcgggtttttaattttatttttttattttttaattaaggtaaatttagaaggtaagatgtaggggggtgtggggtatagtcgtttagtagtttataagttggttttttaaaaatttatttattattggggaaattaggtaagtttttagtttgtttgatgttagaaggtttggttgatttttagagttacggagataggttttaggagatttttagaaatgtttggatttatgaaggaggtatgtgttttgtttaatttggttttatattaaatgatttaattttttaaggggaaaatttttttattttttttttaaggcgttggggttattaaagtttgtgttcgtacgttttaagttattttttagcgatagtattttgagagttagattttttttaagtttttttttttttaaaggttaagtagagtcgatagagtattttttggggttagcggtaattgttgtgtgaaggaggtattagaagtgtaattttaagaaggtaaaagtaggtttaatttttagttaaaataaatttttggatttcgcgagtagttaaagaatatttagagttgagttttatttgtttttgagtcggaggtttggtttttaagtttttttagcgtttattcgttttttttttgtcgggagtttttttttttaagagtcggtagatgttggagggaagcgtttgttgtaagattttttttttcggtttcgtagattgtagagttcgcgggatcgttgaacggaggtattgtcggttgagttgggttttaagtgtttatgggtttataaattagttgttatttgttataaatatgtataaatggaggttataaggatgtgggggtgttggggatttaaagtttcggaattaggaggcgatttattttttttttttttcggttttttttttttttgtcgagcgttttgagatttatatgtatttagatgattagttcggttttttttatcggttagtggttagaggtttttggatattcggagaggggtgggagggtatttttaggttttggatagttgggttatatttaaagatttaatgaatttaaattttttgtggtttgtgttttcgaagttcgatttgggatggttaggatagtaaagttggttgaggttgtttggtttagggcgttcgtacgtcgttaaatttaattcggtttagagtcgtgatttcgtagaatagggcgtaataggttttaggaatgtcgggtgattttagttattttttttttgttttcgagttttgggttttttttttatttttttttgaagttttttcggagtttaagttattttatatttaaatttcgtagttggatgggagtttaggttatttttttattcgtagtcggtgggttaaggagttttggtgttaaatttggtcgcggtataggcgttaattggtaaagggatgatttagcggtggggtttggaaggcgagggttcgcgttttgtatttttgaattttggtttgggaggtagtgatttttatttgggttaataaattatttagaaagtattagtgggattttttataacggtgttgtgaacgagtgtagggtttatttacgttttgtgtacgttcgaaatgaaacgggagttttgaagacgatatttggataatttgataaaaaaaaaaaaaaggtgggcgggggagatagtttttattgttttttttgcgtttttgtttttagttttagagatattataggtgaaaataatagcgggttggttgtttaggtttgagtggagcgtgtttttgttagtttgaaagttttttttcgtagttcgtttggatgcgtgcgtttatagtttagtcgtattttggtgatcggtttgggttgtgaagtattttttagcgaatagttttcgtatttggggatattggtataagggttttatggttcgtggattttttagggtttttgagggttgattttatatttagttagatataggttttaagaggaaattatgatttatgtaaaataatgtttttgatttagtggggagcgggggtggtgtttgttatttagattttttttttttcgtttgaagggtcgagttttggtaggttgatacggtcgagtagagaagtttttggttattcgttcggttttaggcgtgatttttaggatgtagtaaaagttgggtaaacgtcgagaaatttttaattttatagaaaggttgtcgggggtttacggggaggatattaaaacgttaggttcgtgattatgagttttcggttcggatgtgatgatataggattggtgaatgttcgggttaaattcgtggtttttcgtagtcgttgttttagtgatagttattaggtttttcgtagttatttgttaaaagtattggcgtcgtttttttttttatcgaaaaattagtcgggatgagttcggattaagggattagatgaggatgtggatattttattgaaatatggtgtaggttagtcgaagtgggtttgtttttttagttgggggagttttagggaacgtgtgagcgggtttataataaggaatatatggtttgtgggaagataggaagagagaaggaaaataggaaaggaaaaagaaaagaggaaaagaagagagaggtatttttttttttaaaggtagtgagggagggagagaagaataaattttatagtagttggtgttttagtttatttgggtttgagaaaattatttttaggtaaataaggaagataggatttcgtcgttcgattttttagggcgggaagaataggatgttttgtaaaaaataagtaagttttgtttaattttttaaaaaatgttttgtttaattaggtaaaagtttatggtggggtgggggtgatgtttagaagatagatttttcggtaattgttttttggtgtgtgtattcggggtgtgtgtattcggggtgtgtgtattcggggtgtgtgtatgtgtgtgtgtgaaagaatttggtgtgtgtgaaaggggtaagggttgaaggattttatttagttgggggatcgttttgtattgggagcgggtagtttaggttttggaaagattagaaaatttgatttgtgcggaggtaggtgaaggttgtgagtgaggtgggggcgggaatagagttggaggaagtgaataaaagaaattttggggttcgttggtttttttgattcgtggagtaaaaaagtaggcgagtgattattttaggaatttttgttttcgggcgtcggtatataaagagttggggttgtgtgttttgtttttgggggaggagggtattgggaagggggaattaataggtttttttttcgttcggattagg

SEQ ID NO: 113 - DNA, 8333 bp, Artificial Sequence
  chemically treated genomic DNA (Homo sapiens)
ttggattttttagagaagtagtgatgtttaaattgagaaatgaaggtttagagaggtaaagaaatttgtttaaggttatatggtatttgtttttgtggtagttttagaattaggatataaggttatttaaggatttttttgtagattatattaaatttagaggttttttagagagggattgttgtttatggttatataaagggtaaggtttttttgggtttttatttttttttagtttttacgtgcgatgttgaattatagttttatggtttattttttttttattgtattattttttatggaaaatgaggtttgaatttttattatgtattattagttgggttaagttgggtgtttttatttttaatttattttaatttaaagagaagataatttggtaaagatatttgcgtgtattttaaagttagtgtttagattttaggatttaggagtttgggatttgtttttattttttattggtttttagtatgattttagataagtttaagttttagtttttttttttgattaatgtgaatgaatggtttttgtttagtttattatataaaggggtaataatatttagggaaaggggatagaggataggtaaatttatttattaatgttaaagtttttagtgtggtttaattattttgggggttgatttagttagttttatttttagggtaaattagttagaaatggggaaggtgattaatagtagtaagaattttaggaaattgatgaggttatgatagaggtaggagggttagttttggggtatatttgtaggtgagagtagaggtggttaattggatttgtacgatagttgttaagcggagtgaatttgggtaagtgtattttacgtttatttttttttcgagaggtttttttttttttagggtttttaatttggttttttgtttaatattttcgtatttttgggtagttgtaagttagggtttgttttttttttttatatattaatatttatttgttttaagtttaataatttttataaggttttattttttgttaggtaatagttatttaattttagaatttagttcgcgtgatgatgttttttttattggattgagtaggggttaattttttcgtttaatttatattgtttatttatatttggtatggagttaggagtatttgggtatttgtaaatatgtattgaatattgttggtaaaatatattttttttatattattagttttagaagtgtgttttttaggagtttttatgaagatgatgttttagtttatagggataaattataaatagtttattaacgggagttatagatgaggaattagattattattttttattttatatttaattttaatgttttaatgattattaaaaaatgtttattttacgagatggcgttattgtattttagtttgggggatagagcgagattttattttaaaaaaataataaataataaaaaataaaaataaaaaaaaattttgtttattttaatttaagaaaattgttaggggtcggggttaggggtagggttagaaagatgaggtttatttaagttaaatgttttggtttttggagatttaggagtttaagttgggagtaaagtcgagatagttttagaatttgggatgaggttatttgtcgttttttttttaattttggataggaagtagtcgggagttttgttttatttttttaggaagttttgttttttgggttaagttttagagtattgaggttttattttgtgtttggttttgatttattaggttttttaagagatttttggatagggagagtttttaggataggaaggttagggagggattaaatttaaggttaggcggttaggttgaatagcgtgggatttggtttgtaggttaaaggagttatagaagattttgagggtaagatagaagtagggtagatttaataggtagttgaggatttgttattttggtttgtatatttaggagatgtttagttttcgggtttttagaggtgttttttagggcgaaaatttttttatttttttgtagtaggtgtttttagggtgttggtggttttttttgtttagatttcggttttttttatgcgaaatagaaatttgaaacgtttttttaggtttaaagggttgataagagtcgaggataaatgtggtgaggtgaggttttggaagataggagtaacgttggttggttttggggttaaagttttatgattttagggagggcggatcggcgttagtattaggcgtcgggtttagttttttttttatatcgtattttttttttagttttttttcgtagggtgcgacggtatcgggtcggtcgatttttcggaggtagagattcgggtttgggggttgtcggtcggtttttttcggtttcgtcgtgttaggcggttatttatcggtttttgtttttacgtcgtttcgtttcggggataagtagtttttttgcgagtttagaaagtcgaagttcgattgttggaagcggttaaaattatttaggggtagcgttcggtatttagatttgtcgagtatggtttttgataggagatacgtttcgcgttttcgcgcggcgttttttttggttagtgggttttacgcggtttcgtttttttggttgttgttttcggttttattcgcgcggttattcgcggcggcgcgggcgtaggaagaggaggtcggtcggggttcgttttcgtcgtcgtatggttttttttgcgttgggaggatcgaattgtagtttagggttattgggtgtgatcggcgtttttcggatttcgttggggttatcgtttttttttttttttttttatttagttttagaaaagttggaggggaagttgggtacggtggtttatttttataatttattaatttgggagatttaggtaggaggatcgtttgaggttaggaatttaggattattttgagtaatatagtgagagtttatttttataaaaaatttttaaaaattagtttggcgtgggatgtttgtttgtggttttagttatttgggaggttgaggcgggaggattttttgagtttaggagtttgaggttgtagtgagttatgatcgtgttattgtattgtagtcggagcgagagagtaagattttattagggtttataggaagttaattttttttaggattaaggatatgttatattagtttttttagtatttttttttttatattggaggtaggatatgttatatttggattttgggtttttttgggatatagtttgtaaattatttttttttgtgaatttatagtttagtaagtagggattggtatagggtaggttttaatatttatttgttaagtaatggtttggttaggttatcgtgattaaggtggagtaggaaggtttgaattttggtataaaaagaaagaagttttatatgtagatttcggggagtatgggagtgtaaggaagaaggggatagtatagagttatatgagggtaggggttttagagtattatagaggtgaggtttttagttttgtaggtttagaaagagtatgttttttgatttaggtatttggaattaatttgtttttttagggtttgagaaaatttgaatgtaattcgtgaattttttttgagaagtgttaatttttaataggattttggggtagtttgggagtaggttattttttaaagtaagtaaagaaatgaataaagtttttttagttttgtttttttagttaatcgtttttggttttcgaagttttattttgttatagtttatttttaggttttttgtgtagatggttgtttattatatttggtttttatggattgattttttaaaggtttgggagtattgattaggttggagggaagggtaggtttttgaggttttatagtttttaggaagttgcgtatttgtttaatttttgttttttattttgtagattgtaaggtttataagagttaggttttattattattttttttagtttgtttttaagttggaatagagtacggaatgggtatataggagttagtatagtggttgcgatggtttaagtttgaagtcggggcgttgatttagtgaggttatttggaattgtgtttttttttttttattagttgggagtttgatatgtttttttattggcgaagatttagttggttttttttttattttttttatattcgttttttagtttttttttttttttttgtttttattattttagatttattagtttttttagttgttatttaaggtattattttgtttttttatttttagttattggttttttaggatttttgaattaagttttttttttgtattttatagttattgttttagattagggtatttgtttttaggttgttagagtgattgttttattatgtatagttgatcgtgttgttttttggttttaaattttttagtaattttttattatttatagaattggtttaatttttttagttaggattttgttttagtatattttttgggtattattttttatgaatttttttttaaatttgaaaatggttaaaattagtttttaaataggtttttgtaagagttattttttttgttttaagtgtttttcgtattttattatttataattttaaatttttggtgaatttttattgtttttgtaggttttagttgtgggtttttttttttagaatgttttcgtttgtaggtttgtttttttattatatttacggtttttagaaagtaggggttgcgtgtggtttatttttgtacgtttagttttcggtaggacgtggtacgaagtagtgttagtgtgaacggatgaatggattaaagtcgggagtagggttgtttttttgtagttttgttttatttttttcgttttatcgtaagttagcggtaggtttgtagtttttcgtttttatttttttttcgttttgggcgtgtttttaaaatttatagtcggtttttttgttttttagaatcgtttttagtttttgttttattttttttttagaggcgggttttgagtcggtattttttttttcggatagtttaagggatttagttaattggtttacgttttttttttagtttttttttacgtattttaagatttaaatcgagaatcgaaattaagttggggtttatggagtttgtattcgttcgattttcgaggttttagtaggatttcgttcggttttaggagtttattatgttttttttcgagattttttttgaaggtcgttagtttagttttagttttagttttatagaggtattattgggttaggggatgatggggttaagttttgttggtttgttgtggtggggagaggcgggaagagagggtttaacggaggatttggttaagtattttagagagtgatataaagcgggaagtttagatattagggttttgatcgtttcgggtggggtagggaagggagggtaggatagagtagaaaagaggatacggaggagttggggcggtttcgttgggttgcggtttttttattgagtagttgggtaaggtgagaagggttagtggttttcgggtttgggttttttcgtttattttcgagttttgttttaattttgttttagatgtaggattttagattagggaggatggaggtagtatttttgttgcgttggtttggagttaggggtatgttttaggtacggtaaaattaaaattaattttttagattcgaggtgagaaattggtttagattgaagaggtatttttgttaaggttttttagtttatgtggtttttgtttaaggaagtttttttaacgaattttttttttgttatattttttttgtttattttttatttttttcgataaaggaattatttgggttttttgttttgttgttttttaggtttttttatttttttttatgaaagtatagaggatatcgtattatagtaatttttataaatattattataattaagaataatattatttaataatattaggtaatatttatgagtattttaaatgtgttaggtattgtattaagtattttggtttttttttgttgttgtttgtttgttttgttttgttttttgtttgtttgtttatttgtttgtttttgagacggagttttatattgtcgtttaggttggagtgtaatggtgcgatttcggtttattgtaatttttttttttcgggtttacgttatttttttgttttagtttttcgagtagttgggattataggttacgttattatatttggttattttttatatttttagtagagatggggttttattatgttggttagattggtttttaatttttgatttcgtgatttatttatttcggttttttaaagtgttgggattataggtatgagttattatgttcggtttgtttttgtattttataaaatgtggtaaaatatatttaatggataagtttttatgttaattatttataagtgtattatttagtggtattaagtagatttataatattgtgtaattattattattatttatttttagaatttttttattattttagaaattttgtattttttaaattataggggagggaaagatggtttgtttttatttttttagtttttttggttgggttatgaattaaatagtttatgaattaaatagttataaaatagattattagcggaaaatttatatttaattatatatgtatatttaggagttttataatatatgagatttaaagaaaggttagatgattgaagtttgtataatattttgagttacggaaaagagtttggagtttttgggtgatggtgataatataagttatgggagggtgaggagaggagttgtttggtgaatagaggttgttttgttatgtagattaaaagtttttagataataaaagttgtttggagtagtttttttttaatatagattattttattaatgtagatttttttttaagatataaatgttttttttttttataaaaggagagttttttagagttatttttgtattagtagttttttagaataattagtttaaaatatgttaaagaagtatattttaagagttttttgtagttatattttgaagtggtgtgttttgagttttagtaatgtaatagttttttatttttttttttttttagtttttggtaatttttaatttattttttgtttttatgaatttatttattttagatattttatgtaagtggaattgttattagtagaggattttgattgtaaattgtttaggtttttggtattttgaataaagaattggataaaatgtatagtaaagtaaggaaagagtgaagtaatgaaagtagagatttattgaaaatgaaagtatattttatagggtgggagcggttagagtagggtttaaggattttagttatagaattttttgggttttaaatattttttagaggttttttattggttatttggtgtttattttattggttgtagaaagtaattaattagacgtatttttaattttttatttgttttgtaggaaatggggtgatttgtaaagagagtagttttttttttttttgttattgaggtatggagagttgcggtttttttttcgatttagttttaggaagttagagggaatcggttttaggttttttgtttttagattttatttttttgttttagaattatatagtgtttgattttttgtgattggtttattttatttagtataatgttattgaggtttatttatgttgtagtatgtattagaattttatttttttttaacgttgagtaatattttattatatgtgtagattatattttgtttatttatttatttgttgatggatatttggattgtttttatattttgtttattgtgaatagtgttgttgtggatattgttgtataagtatttgtttgggttttgtttttatattttttggttatatatttaagagtggaatttttgggttatattgttgttttatgtttatttttttaatgaatttttaaattgtgtattaagtattttatatgaggttggtatttagtgtatttattttttaaattgagttttttgaaggtagaatgtattttatattttttatattttagagtttattattgtgggtgatgagaagtagatgtttaataaatggtgtagtgagagttggagggtttgaataaatgggggtattggggtgttgataagttagggttttgtattatttaatgattggttggaatggaatatgaggttttattttagggtttagttgtaagggtggttggtcggtaggtgggggtttttgggatttttttaggttttatttgtttttttggttttttagt

SEQ ID NO: 114 - DNA, 8333 bp, Artificial Sequence
  chemically treated genomic DNA (Homo sapiens)
gttgggggattagagaggtaggtgaggtttggagaagttttaaaagtttttatttatcggttaattatttttatagttggattttggagtaggattttatattttattttagttagttattggatgatgtaaaattttggtttattagtattttaatatttttatttatttaggttttttagtttttattgtattatttattgagtatttattttttattatttatagtaataggttttgagatataagaggtgtaggatatattttgtttttaaggaatttagtttggaaggtagatatattaagtattaattttatataaagtgtttaatgtatagtttgggggtttattaaagaggtaagtatggaataataatatgatttagaaattttatttttagatatataattaaaagatgtaaaaataaggtttaaatagatatttgtataataatgtttatagtaatattatttataatagataaaatgtagaaataatttaagtatttattaatagatgaatagataaataaaatgtggtttatatatataatggaatattatttagcgttagaaagaaatgaaattttgatatatgttataatatagatagattttaatgatattatgttaagtgaaataagttagttataaaaggttaaatattgtatgattttgaggtaggagaatagggtttggaggtagggaatttaaggtcgattttttttgattttttagaattaaatcgaaaggaaaatcgtaattttttatgttttagtaataaaaggaagagaggttattttttttgtaaattattttattttttgtagggtagatggaaaattgaaagtacgtttggttggttgttttttgtaattaatggggtgaatattaagtggttaatgggaaatttttagggggtatttggaatttagaagattttgtaattggggtttttgagttttgttttagtcgtttttattttgtggggtgtatttttatttttaataaatttttgtttttattgttttattttttttttgttttgttgtatattttgtttaattttttgtttaaaatgttaagaatttgaataatttgtagttaagattttttattggtaataattttatttatatgaaatatttagaataagtaagtttatagggatagaaggtagattagaagttattaagggttaggggaaggagaaaatgaggagttattgtattattggggtttaggatatattattttaaagtatgattgtaggaggtttttgaaatatatttttttggtatattttaagttggttattttgagaaattgttgatataggaatagttttgaaaagttttttttttgtaaaaaagaaaggtatttatattttaaaagaaaatttatattagtaaaatgatttatattaaaagagggttgttttagataatttttattatttaagaatttttaatttatatagtaagataatttttatttattaaatagtttttttttttatttttttataatttgtgttattattattatttagaagttttaagttttttttcgtagtttaggatgttatataggttttaattatttgatttttttttgagttttatatattgtgggatttttgagtatatatatgtaattaaatatgggtttttcgttggtaatttattttatgattatttaatttataggttatttaatttatagtttagttaaggaaattagaagggtggaggtaagttattttttttttttttatggtttaaagagtatagagtttttggagtaatgaaaaagttttggaaatagatggtggtgatggttatataatattgtgaatttatttaatgttattgaatggtatatttataaatggttaatataggaatttatttattaggtatattttattatattttgtaaaatataaaaataggtcgggtatggtggtttatgtttgtaattttagtattttgggaggtcgaggtgggtggattacgaggttaggagttagagattaatttggttaatatagtgaaattttatttttattaaaaatataaaaaatagttaggtatggtggcgtggtttgtaattttagttattcgggaggttgaggtaggagaatggcgtgaattcggaaggaggaggttgtagtgagtcgagatcgtattattgtattttagtttgggcgatagtgtgagatttcgttttaaaaataaatagataaataaataaataaaaaataaagtaaaataaataaataataataaaaaaaaattaaagtgtttaatatagtatttggtatatttgaagtgtttataaatgttatttagtattgttaagtaatgttatttttagttgtaataatgtttataaaagttattgtaatacggtgttttttgtatttttatgaaggggagtaaaagggtttgaaaggtagtagagtaagaaatttaagtagtttttttgtcgggggaggtgggaggtgggtaggaaaggtgtggtaagagaagggttcgttggggaggtttttttaagtagaaattatatgagttgggaggttttggtaaagatatttttttagtttgagttagttttttatttcggatttgggaagttggttttagttttgtcgtgtttgggatatgtttttggttttaggttagcgtaataggggtattatttttattttttttaatttgaagttttgtatttgaggtaaagttgaggtagggttcgagggtgggcggaagggtttaggttcggaggttattgattttttttattttgtttaattgtttagtggagaaatcgtagtttagcgaggtcgttttaattttttcgtgtttttttttttattttattttatttttttttttttgttttattcgagacggttaggattttggtgtttggatttttcgttttgtgttattttttagggtatttgattaaatttttcgttagatttttttttttcgtttttttttattatagtaaattaataaagtttaattttattattttttaatttaatagtatttttgtagggttggggttggggttgggttggcggtttttagagggggtttcggggggaggtatggtgggtttttggggtcgggcggggttttgttggggtttcggagatcgggcgggtgtaggttttatggattttagtttagtttcgattttcggtttagattttggagtgcgtgaagagaagttgaaggggaggcgtgagttagttggttgagttttttgagttgttcgaaaggggaggtgtcggtttagggttcgtttttggagaggaagtgagatagaagttgggggcggttttagggggtagagaggtcgattgtgggttttaaagatacgtttagagcggggaggaggtagaggcggagagttgtagatttatcgttgatttacggtaaagcgggagaggtagggtagagttgtaggggggtagttttgttttcggttttgatttatttattcgtttatattggtattgtttcgtgttacgttttgtcgggagttgggcgtataaagatgagttatacgtagtttttgttttttaagagtcgtagatgtaatggaagagtaagtttgtaaacggagatattttggaaaggagagtttatagttgggatttgtaaaagtagtggaaatttattagggatttagggttgtaggtggtggggtacgggggatatttgaaatagaaaagatagtttttgtaaaagtttgtttgggaattaattttggttatttttagatttaagagggaatttatgagaaatgatatttaaggagtgtgttaggataagattttagttgaggagattgaattagttttgtgagtgatgggaagttgttgaaggatttggaattagggaataatacgattagttgtgtatgatgggatagttattttgataatttaggagtaggtgttttggtttaggatagtggttgtgggatgtagaggagggatttgatttagagattttgggaagttagtgattggaggtgagggagtaggatgatgttttgagtgatagttggaaaggttggtggatttgaggtggtgggggtaggagggagggggagagttggagagcgggtatgaagagggtgaggggagagttagttaggttttcgttaatggaaaagtatgttagatttttagttggtaaggggaaaggggtatagttttaggtgattttattgggttagcgtttcggttttaaatttaaattatcgtaattattgtgttggtttttgtgtatttatttcgtattttgttttaatttagaaatagattagaaaggatgatgatagggtttggtttttgtaaattttatagtttgtagggtggagagtaggggttgggtagatacgtaattttttagggattgtaaggttttaggagtttgtttttttttttagtttggttagtatttttaggtttttagagaattagtttatgaaagttaaatatggtgggtagttatttgtataagggatttggaagtgggttatggtaggatggggtttcggaggttagaggcgattggttgaggaggtagagttggggaagttttatttatttttttgtttgttttggaagatagtttgtttttagattattttaaagttttgttggaagttaatattttttaaaggaaatttacgagttgtatttaggtttttttaagttttggagaggtaagttaattttaggtatttggattaaggggtatgttttttttggatttgtaggattgagggttttatttttgtggtgttttggggtttttgtttttatgtagttttgtgttattttttttttttttatatttttatgtttttcgaagtttgtatgtgaaatttttttttttttgtgttaaagtttaggtttttttattttattttgattacggtgatttggttaggttattatttaataaataagtattgagatttgttttatgttagtttttgtttgttgggttgtgggtttataaagaggaataatttgtagattatgttttagagaaatttaaagtttagatatggtatgttttgtttttagtgtgagagaaagagtgttgagaaggttgatatagtatgtttttgattttggagaagattggttttttgtaaattttgatgagattttgttttttcgtttcgattgtagtgtagtggtacgattatagtttattgtagttttaaatttttggatttaagagattttttcgttttagttttttaagtggttgggattataggtaggtattttacgttaggttaatttttaaaaattttttgtagagatgggtttttattatgttgtttaggatggttttgaatttttggttttaagcgatttttttgtttgagttttttaaattgatggattataggagtgagttatcgtgtttagttttttttttagtttttttagggttgagtaggagaagaggggaggaggcgatgattttagcggggttcgaggaacgtcgattatatttagtagttttgggttgtagttcggtttttttagcgtagggggagttatgcgacggcggaagcgggtttcggtcggttttttttttttgcgttcgcgtcgtcgcgggtggtcgcgcgggtgaagtcggaagtagtagttaggagggcggggtcgcgtagggtttattggttagggagggcgtcgcgcggaggcgcggggcgtgttttttgttaaaagttatgttcggtaggtttgggtatcgggcgttgtttttgggtgattttgatcgtttttagtagtcgagtttcggttttttgggttcgtagaagggttgtttgttttcggagcggggcggcgtggggataggggtcggtgagtggtcgtttggtacggcggagtcgggggggatcggtcggtaatttttaggttcgaatttttgttttcgaggagtcggtcggttcggtgtcgtcgtattttacgaggggggattgagaaagggatacgatgtggagagggggttggattcggcgtttggtgttagcgtcgattcgttttttttagggttatggggttttggttttagagttagttagcgttgtttttattttttaaaattttattttattatatttgttttcggtttttattagttttttaggtttgggaagacgttttaggtttttatttcgtatagaagaaatcgaggtttaggtagaggaggttattagtattttaaaggtatttgttgtagggaaatggaagaattttcgttttagggggtatttttagaagttcgggaattaggtattttttggatgtgtaggttaaaatgataggtttttagttgtttgttggatttgttttgtttttgttttgtttttaaagttttttgtggtttttttggtttataggttagattttacgttgtttagtttaatcgtttaattttggatttgatttttttttggtttttttgttttgaaagttttttttatttagaagttttttgagaggtttggtggattagagttaggtataaagtggagttttagtgttttggggtttagtttagagggtagggttttttggaagaatggagtagggttttcgattgttttttgtttagggttgggaggaaagcggtaaataattttattttagattttggagttgtttcggttttgtttttaatttgggtttttgaatttttaggggttaggatatttggtttggataagttttatttttttagttttgtttttgatttcgatttttaataatttttttgaattgaaataggtagggtttttttttgtttttgttttttgttgtttgttgtttttttgagatggagtttcgttttgttttttaggttggagtgtagtggcgttatttcgtgaaataggtattttttaatggttattaaggtattaaagttgggtgtggaatagaaaataataatttaattttttatttgtggttttcgttgataagttatttatgatttatttttgtaggttaaggtattatttttataaggatttttggaaagtatatttttggggttgatggtataggaggaatgtgttttgttagtagtatttagtgtatgtttatagatgtttaggtgtttttggttttatgttaggtatgggtaggtaatataaattaaacgagaggattgatttttatttagtttagtgaggagagtattattacgcggattggattttgagattgaatggttgttgtttagtagagaataaggttttgtgagggttgttggatttgggataaatgagtgttgatgtatgggaggagggaatagattttaatttgtagttgtttaaagatacgggaatattaggtaaggagttagattgagagttttgagaaggaaggagtttttcgaggggaaggtgggcgtaaggtatatttgtttaagtttatttcgtttggtagttgtcgtgtaggtttagttgattatttttgtttttatttgtagatgtattttagagttggtttttttgtttttgttatggttttattagttttttggggtttttgttgttgttggttattttttttatttttggttggtttgttttgaaggtaaggttggttgggttagtttttagggtggttgggttatattgagagttttggtattgatgaataaatttgtttattttttgttttttttttttaaatattattatttttttgtgtaatgggttaggtaagaattatttatttatattggttaggggaggaaattaaggtttgggtttgtttaaagttatattgggagttagtagggggtagaagtaagttttaaatttttaagttttgggatttggatattggttttaaggtatacgtagatgtttttgttaaattattttttttttgggttagaataaattagaaatgaaaatatttaatttagtttagttggtagtgtataataggaatttaggttttattttttataaggggtggtatagtgggaaaaggatgaattatggagttatagtttagtatcgtacgtgaaagttgggggaaggtggaagtttaaggaggttttgttttttgtgtagttataggtaatagtttttttttagaaaatttttgggtttggtgtggtttgtaagggggtttttaaatggttttatattttagttttaaaattgttatagaaataaatgttatgtgattttgaataggtttttttgtttttttgggtttttattttttaatttggatattattatttttttaggaggtttag

SEQ ID NO: 115 - DNA, 5951 bp, Artificial Sequence
  chemically treated genomic DNA (Homo sapiens)
ggtgaagtagaattattttggttgaaggggacgtagagggtttgttttttattaaggttggtattgacgattttatagaatatagtttgaaagtttttgttgtaagattagttacgaaatgtatttttaggttataaaataaattaatttgttagattagaatgtttatttttatgaataggtgaaatgttggggatgtttataaaaagtaataattttttatttagttatttaaggtaattataattattaaaatatattttttagtgtttggattttttagtttttaataaaattatgtggtagtattaagagttaattttagtataaggaaggttgtgttagttttagttttgtgtttttttttgtttgtggagaaggtttgatttgttaattgtttttaatagggtgtggttttttgagaaaaatggtattttaaggtttaagaatattgtaggtattttagtttttatatttgtattttgggtagtaggaagataaaaaaaggaggaagaataaatttgtttgttttatttttttgagatagagttttgttttgtcgtttaggttggattgtagtggtgagattaaggtttattgtagttttaattttttaggtttaagtgatttttttatttaagttttttaagtagttgggattataggtatgtgttattatatttagttaatttttatattttttgtagagttatagttttatatgttgttagggttggttttgaatttttggttttaagtaattttttcgtttcggttttttaaaatttgttttttgaaaaagtatttttagaaattttattaaattaattttttataatttaatagttaaaattttgttatatatggttatatttagttgtaagggagtttgtgtgttgtattttagtaagatagatggaatatatttttgttgatattttagggttgttattaaggaatatttatttagtaatggtaatagttaggtagaagtaattattatttttttgtattattgtgttatgtgtgtattttattatatgtatagatttgtgttattattattatatttaggatatagaataattttattaattattttttttttttaaattttttttgtgtttattttttataattatatttttttttgtaattattttttggtaaatattgatttgttttttattattatagttttgttattttattaatgttatatagatggaattatatagtatatggtatataattttttgagattggttttttttagttagtataatgtttttgagatttattgaagttgttgtatatgatagtagtttattttttttaattgttgagtagtattttatggtatgaatgttttatttatttatatgaaaaatatttgaattgtttttattttttggtaattataatagttgttatttgtttttaagtgaagttaagtttttatttatatatatttttttatttgtatttatttattaaaattatttttttgagatagagttttattttgttatttaggtaggagtgtagtggtattattatagtttattgtagtttcgaatttttgtttttaagtagtttttattttttattttagttttttaaggagttaaggagttgggattataggtgtgtgttattatatttattttaatttttggttttttgtagagatagggattgtgttgtttaggttggttttgaatttttggtgttaagtaatttttttgttttagttttttaaagtggtaggattttaggtgtaattattgtatttggtttatatttttattatgatattatatataaggatattgtttgttaatgtgttgttttttttttatattgaattatatgtatttatatggtttaatttgtgattttattaaattttatgttaaattataatttttaattttggttgtggggtttggagggaggtgattggattatgggggtggattttttttttgttgttttggtgatagtgagtttttatgagatttggttaagtgtgtattttatagtttgtggaattgtgagttaattatatttttttgtaaattattttattttaggtatttttttatagtagtggaagaatagattaatatagaggtgtttggattattggggtagattttttatgaatggtttagtattatcgttttggtgttgtttttatgatagtgagtttttgtaaaagtgtgtggtatttgtttttttatttttttttttgtttttgtttttttgtgtgatgtataagtttttgtttggtttttattacgattgtaagtttttagagttttttttagaaatatagttttttttagtgttatgttttttgtatagtttatagatttatgagttaattaaatttttttttttgtaagttattaagtgttaggtatttttttatagtaatgtacgaatagtttaatatatgtatttttaagattttgtttgatttaaagtaaataatttagtgtagtggttaagagtacggttttttgtttgtgtttgaattttagttttaatatttaatagtggtgtgatattgggtaagttatttgatatttttatgttttaatttttttattttagataattgggataaagagtttttattttttagggtattgtaagggttttttttttttttttttaaagtgatatatgtgagtttgttgaggttaaagtagtgttttatatatttttttatttttagtatttagtaagtttatgagaatgtagatgtttataattttttattgaataaatgatattaattttataaataattttaatatatataattgtatatttattatttttttttaataaatatgaatatttattatgtttaggtattgtgttaggtattggggatagttggaaatataaataatttattaggaggaaaatgaaattttgatatagtttattttaagttatttttgtttttatagaattatttttttttaaataaaaattttttttatgaaaatttttttttatagaagtgaaatagtaaagaatgtataatatatatattagttttaatgatttttcgaaggttatattaatatattttttgaattaaagagtaaaattaggattaaatagaagataggaaattaaatgagggtatttgagtttttttttttaatggagatgattttaaatttgtggtttttagagtaggggtatgtatttaattatttttaataaggttgttaattttgagattttttttatagtaatgttggtgaaaataatttaggttatatttttagattaattagttaaatattttatttttttaagtgtgttggttggcgtggttttaaataattagattatagggcggtttaattatttggtttaaatagttatgtatatattttaaggtttaattattacgaataaattaattttatttttaaatcgttgtttgttattgataatagttttaattgtatttgtatagttaaaggagtttaacgagtattttaggattgatgattaaaattttatttattaaaataattgtatttatttggaaattagttttgtttttaattgtagaattagtagttttatttaatttaaattttagttatattttttaagatagattaattagagttgattttttttaaattttgtttattatgaaatatatttttttatttttaaaaaataaataaataaataaaaatagggttttaaaaattcgtaaaataattagatttgggattttgtttagggaatttcgttatttaagataaagaaaatttagtaatattatgtttagttattaagaaagatatgtgtaacgcgaaatttttttttaatattatatttattttgagaaatatagtaaaataaaatttacgatgaagttacgatttcgatatttttattagttattagtttattgttaggttttaaaaggtgttttaaggcgggaagaaggcgcggggggaagttttagaatatggggtttgtttcgattggggggagcggcgttagaggggcgtgaaggtagaaaggaagggtagggcggaaattagcgatttaataagacgtttagttttcgaggaagttagtttggcgttagaagtaagtagagtagaagagatttagggttaattaaaataattatacgatattttttttcgcgtttgtcggggtcgggttttttgtattagtagagtcgggggcggggattagttcggatttaaatttaaagcgggaggttcgcgtgtggtttagtaggtgttttatgttcggttttcgtggcggtcgttttcgtttttatttgtttagagggtcggaaattatttagcgaggagcggtttatttattgttgttaatgttttaattgcgcggaaattttgaagaaagtgcggagtatagggtacgcgggtcgtttattgtttttttacgcgtttttacgtttttggtcgttgcgttttttgtcgtgtttttataatgttataggttattgggggagatcggagcgaagttaggagggaagtaaggcgggaggaaaagggagaagtgtaagaagatataggcgttcgggatattatataatttggttttgagttagagggagcgtatgcgtcggcgatatttttggcggtaggagaaaggcgcgtatgcgtagagtcgagacgaaaaatgaagttatagggtgtttggttgattgagggcgttgttttagttatcgaagggttatagcgtttcgaaggcgcgtgcgtagagcgcgggaagggggtggagtttttttgagggggtcggggcgaatagagtcggtttcgcgcgttttttggcgcgcgttcggggagaggaaggagcgggagggggcggagaggagggaggaggtaagtagggcgggaggggggaggggagttagagcgagggagggtttatcgatcgggcgattttggttaaaatatttaaaatggcggacggaggagtagcgagttaagatgagagtttagtcgcggcggtagtagtagtaggtaattattatagtattttatatatttatatttatatttaatttcggttttcgttgttttttttcgcgatttagtataatttattagtatttaggattattataattaacggcggggagatggggggtcggggagtattgagttttcgtcgggcgttgagcggagggggaaagaggttcggagcggttaggcggagggggaagataaggggtaaagggggttgcgatttattgttttttttttgtattcggtttatttcgtcgtcgttcgtcgtttgttcgtcggtatcggttttttttttttgtcggtcgtcgttgtcgttttttcgtcgtcgtgttcgaattcgagcgggttcgcggcggggcggcggggtcggggtagagggagaggataataaagatattttatatatttatagttgttgggtcggcggggcgtagtagggcgcgggcgggcggtcggggtcgggcgggcgcggggtggggggcgtgaagggggatggaggcggcggcgagtataatgtcggggaggcggcggggtcggagcggatttcggcggtcggatattcgtacgcgttttttttcgggagcgggttcgggcgggggggcgttgttcgttttggggggcggtttttagggtaatcgggggtgcgcgcggggagagttttttgttcgcgtttcgcgcggggatgagttcgggggttacggttttaggtatttcggtttcgttttattggtttttaatgtttattttttgttgttagatggtagatatttattttattaataggagttatgtttatttttgtaattgatattttatttttgtttgtatagaataatgtaaaatttttattgaaaaggagtagtatttgtagtattaaatttttttgtgtgttat

SEQ ID NO: 116 - DNA, 5951 bp, Artificial Sequence
  chemically treated genomic DNA (Homo sapiens)
atgatatataaaagaatttgatattatagatattgtttttttttaatgaagattttgtattattttatgtaaataagaataaaatgttaattataaaaataaatataatttttgttaatgaaataagtatttattatttgatagtaagaagtgggtattggggattagtggggcgaggtcgaagtgtttggggtcgtgattttcgggtttattttcgcgcggggcgcgggtagggagtttttttcgcgcgtattttcggttgttttgagggtcgttttttaaggcgggtagcgttttttcgttcgggttcgttttcgggggaagacgcgtgcgggtgttcggtcgtcggggttcgtttcggtttcgtcgttttttcggtattgtgttcgtcgtcgtttttatttttttttacgttttttatttcgcgttcgttcggtttcggtcgttcgttcgcgttttattgcgtttcgtcggtttagtagttatgaatatgtaaaatgtttttattgttttttttttttgtttcggtttcgtcgtttcgtcgcggattcgttcgggttcgggtacggcggcgaggaggcggtagcggcggtcggtagaggaggagggtcggtgtcgacgggtagacggcgagcggcggcggggtgggtcgggtgtaggaggagggtagtggatcgtagttttttttgttttttgtttttttttttcgtttggtcgtttcgagttttttttttttttcgtttagcgttcggcgggggtttaatgtttttcggttttttattttttcgtcgttaattataataattttgagtattaataaattatgttaagtcgcgggggggggtagcgggagtcggggttgagtatgaatatgaatatgtaaaatgttgtaatgattatttgttgttgttgtcgtcgcggttgaatttttattttgattcgttgttttttcgttcgttattttgaatattttaattaaaatcgttcggtcgataaattttttttcgttttggttttttttttttttttcgttttgtttgttttttttttttttttcgttttttttcgttttttttttttttcgggcgcgcgttagggggcgcgcgaggtcggttttgttcgtttcggtttttttagaagagttttatttttttttcgcgttttgcgtacgcgttttcggggcgttgtggtttttcggtagttaaagtagcgtttttaattagttaggtattttgtggttttatttttcgtttcggttttgcgtatgcgcgttttttttttgtcgttagaagtgtcgtcggcgtatgcgttttttttagtttagaattagattatatagtatttcgggcgtttgtgtttttttatatttttttttttttttttcgttttgttttttttttggtttcgtttcggttttttttagtggtttgtggtattgtaaaagtacggtaaggagcgtagcggttagaaacgtgggggcgcgtggaagggtagtgagcggttcgcgtgttttgtgtttcgtattttttttagggttttcgcgtagttgaaatattggtaataatggataagtcgtttttcgttaggtaattttcggttttttgggtaggtaggggcggaaacgatcgttacgggagtcgggtatgaggtatttgttgagttatacgcgggtttttcgttttaaatttgaattcgagttaattttcgttttcggttttgttagtgtaggagattcggtttcggtaaacgcgagggggagtgtcgtgtgattgttttaattagttttaaattttttttgttttatttgtttttaacgttaggttggttttttcgggagttaggcgttttattaagtcgttaattttcgttttattttttttttttgtttttacgtttttttaacgtcgttttttttaatcgaaatagattttatattttgaggttttttttcgcgtttttttttcgttttggaatattttttaaaatttagtagtaagttgatgattaataaaaatgtcgaaatcgtaattttatcgtgaattttattttgttgtgttttttagagtaaatatggtattggggaaaggtttcgcgttgtatatattttttttggtaattagatataatgttgttgagttttttttattttaaatggcgaaattttttggataaagttttaggtttaattattttacgaatttttaaagttttatttttgtttgtttgtttgttttttaagaatagaaaggtgtattttatggtaagtaaagtttaaaaaaaattagttttagttaatttgttttgagagatatgattgaagtttaaattgggtagaattgttggttttataattaaaaataaaattgatttttaagtgagtgtaattattttaatgggtaaagttttaattattagttttagaatgttcgttggatttttttaattgtgtaagtatagttaaagttattgttagtgataggtaacgatttgggggtgggattgatttgttcgtggtaattaagttttagggtgtgtgtatgattgtttgaattaaataattagatcgttttgtaatttaattatttagagttacgttaattagtatatttaaggaaatgaaatatttaattagttaatttggaaatatggtttaagttatttttattagtattattgtaagggaagttttagaattgataattttattggaaatagttaagtatatgtttttgttttggggattataaatttgaaattatttttattaagaaaaagagtttaaatatttttatttaattttttgttttttatttaattttagttttgttttttggtttaaaaagtatattaatatgattttcggaaagttattgaagttagtgtatgtgttatgtattttttattgttttatttttataaaaggaaatttttatggaaaggatttttatttaaggaaggatagttttgtgagaataaaaatagtttaaaatagattgtattaaagttttattttttttttaatgagttatttatgtttttagttgtttttagtgtttagtataatgtttgggtatagtaggtgtttatatttgttgaagaaaaatagtgaatatatagttatgtatgttaggattatttgtaaaattaatgttatttatttaataaaaaattgtaaatatttgtatttttatgaatttattaggtgttaaagataggaaaatgtgtaagatattattttaattttagtaaatttatatatattattttaaaaaagaaaaaaaaaaatttttataatattttgggaggtagaaattttttattttagttatttaggatgggaagattgaggtatagagatgttaagtaatttgtttagtgttatattattattaagtgttagagttaaaatttaaatataggtaagggatcgtatttttaattattatattaagttatttgttttgggttaggtaaaattttggaggtatatgtattaaattgttcgtgtattgttataaagaaatatttgatatttggtaatttataagaaaagaggtttaattgatttatgggtttgtaggttatataggaagtatagtattgggaaggattatgtttttggggaagattttggaagtttatagtcgtggtgaaggttaagtaggagtttgtatattatataggagaataggagtaagagaaagggtaggggggtaggtgttatatatttttataagaatttattgttatgaggatagtattaaggcgatggtgttaaattatttatgagaaatttattttaatgatttagatatttttgtattagtttgtttttttattgttataaagaaatatttgagatggggtaatttataaagaggtgtaattagtttatagttttataagttgtgagatatatatttaattagattttatgagaatttattgttattagaatagtaagggggaaatttatttttatgatttaattatttttttttaggttttataattaaaattggggattataatttgatatgagatttggtggggttatagattaaattatatgggtatatatagtttagtataggaagggaataatatattaataaataatgtttttgtatataatgttataataaaaatgtaggttaggtgtagtagttgtatttaaaattttattattttggaagattgaggtaggaggattgtttgatattaggagtttaagattaatttgggtaatatagtttttgtttttataaaaagttaaaagttaaggtgggtgtggtggtatatatttatggttttagttttttagttttttgggaggttgaggtgagggatgaggattgtttgagggtaggagttcgaggttgtagtgagttatgatggtgttattgtatttttatttgggtgatagagtgagattttgttttaaaaaaatgattttaataaataaatataaataaaaaggtatatgtggatgagaatttaattttatttagaaataaatagtaattattataattgttaaaaagtagaaataatttaaatgttttttatatgaatgaataaaatatttatattatggaatattatttagtaattgaaaagaatgaattattattatatataataattttaatgaattttaaaggtattatgttgattgaaagaggttagttttaaaaggttatatattatgtattatatggttttatttgtatgatattaatgagataataaaattatagtgatggaaaatagattagtgtttgttaggagatagttataggggaagatgtgattataagggataggtataagggaagtttggaggaggggggtggttaatggagttgttttgtattttgagtatggtagtggtaatataaatttgtatatatagtaaaatatatatatggtatagtagtgtaggggagtggtggttatttttgtttagttgttattattattggatgaatgttttttagtaatagttttaaagtgttaataggaatgtgttttatttgttttgttaaagtgtaatatataggtttttttgtagttaggtgtggttatgtgtgataaaattttgattattgaattataaagagttaatttggtgggatttttgggaatgtttttttaagaagtaagttttgggaggtcgaggcgggaggattgtttgaggttaggagtttagggttagttttgataatatatgagattgtgattttatagaaaatataaaaattagttggatgtggtggtatatgtttgtagttttagttatttgagaggtttaggtgggaggattatttgagtttggaaggttaagattgtagtgagttttaattttattattgtagtttaatttgggcgatagagtaagattttgttttaaaaaaataaaataagtaagtttatttttttttttttttttgtttttttgttgtttagaatgtagatgtgaagattgaaatatttgtagtgtttttgggttttgaagtgttattttttttaaaagattatattttgttaggagtaattagtagattagattttttttataggtagagggaagtataggattgggattggtatagttttttttgtattggagttaatttttggtgttattatatggttttgttaaagattggggaatttagatattgggagatgtattttaatgattataattgttttaagtgattaaataaaaaattattattttttataaatatttttaatattttatttgtttataaagatgaatattttaatttagtaaattaatttgttttgtggtttagggatgtatttcgtaattaattttatagtagaggtttttaaattatgttttgtgaagtcgttagtgttagttttgatgaaaaataagttttttacgttttttttagttagaatggttttgttttatt

SEQ ID NO: 117 - DNA, 11036 bp, Artificial Sequence
  chemically treated genomic DNA (Homo sapiens)
  unsure (1927..1928, 1943, 1956, 1958, 1981)
gaaagagtagtgggtaaagatgtaagatatttaagatagtagttttgagaatttattatggaggataaaagagagggaagggtaaagaatagtgggtcgggaatagtggtttatgtttgtaattttagtattttgggaggtcgaggcgggcggattatttgaggttaggagtttaagattaggttgattaatatggtaaaattttgtttttattaaaattataaaaattagtcggatgtgttggtgtacgtttgtaatttttgttatttgggaggttgaggtaggaaaatcgtttgaatttgaaaggcggaggttgtagtgagttgagatggcgttattgtattttagtttgggtaagagatggagtttcgttttaagaaaaaataaaaataaaaaaaatagtgtttagattagataaagaaattaatatttatatatattaatatgtagtaagttcgggtaaagtttgtatttaatgtttttttttttaatttagttgaatttgtattatttagttattaaagagggaaggaatttgaattaatgggtagaaataatataagaaataattatacgtgatatattttgtaagtattaaaatggttgttataaatttgtagatgaattttggaaagattgatgaggattgaaaatgatttatggaattgaaatttaagagtttgggaaagtatagaatttatataaaggataagaaaattttaggattttgttgtttaataaggtagttattagaaatgtggttattataagttgaaatgttatttgttaaaatatatattgtattcgatataaaaaattgtaaaatatttaaagaattttttattttgattttatgttgaaatgtattttgtgtatatagggttaaataaaatatattaaaatgggtttacgtttgtaattttagtattttgggaggttgagataggtagattatttgaggttaggagtttgagattagtttggttaatatggtaaaattttgattttattaaaaaatataaaaaaaaattagtcgggtgtggtggagtgtgtttgtaattttagttatttggggggttgaggtaggagaattatttgaatttggaaagtggagggtgtagtgagttgagattttgttattgtattttagtttgggttatatagagcgagattttattttaaaaataaagtaaaataaataaaaaataataataaaaaaaattttttatatatatatatatatatatatatatatatatgtatattgttttagttttttttattattttttttttaaagatgtcgcgtatagtggattttttgtcgttgagtttttattagttagtatttttttgggatatatattatagatagagtgtatttcgtgtaatacgtattttggtgagttaatttgattggtatatagttacggattttttggagtgatttattaaagttagggttgtagaggggaaggggtgtagtttatcggtttcgatgaaaggggtttcgttcgttagatttggatttcgtttttagagatggggtgttggttcgttttcggtgatatggtattggcgtttttcgtgtggggatgtgagcggtgtacgtgattggacgtgtggttgtggagtgtgtggttggatagagcggggtggagtagtgagaatgatgtgaggggttggggggggtgggggggggtgggtaggtttcgtggggtgtggtgggggagggggtaagtgtggagaggaggattatgacggaatggtgggtgattgggtagaggtagagaggaggtcgtaaaaggatcggtaggatttggaaggtattggaatattgggggaatttgggaaagcgggcggtaacgtggggggaagtgtggggtatggtgggtgaaattgggaggaaattgggtgaaaatgtgggnnnaaaaattgggaaanaaaaatgggggantnaaaaaaagttggtggagtgtganaaaagttggggtcggagagtgagggtatcgtttttgggagtttaatggtcgagatgtgtcgggcgcgaaataatatatttgtgcgagatagattaagagtaaagagtaaaggtaagtatgtgtatatgtatatatatatatatatatatagaaatatattgtattagttttttttattattttattttttaaaatgtggtttatagaagataaatttatattatatttttattagttagtaatgttttgggaaaaataatataaataaaatgtatataatgaaaaataaattttggtgaattaatttgattggaatatagttaaggatttataggagagaaaaattaaagttagggttgaagaggtagaagggatagtagtatttaggatttgaatgaaaagggattttagattggatagattggatttaatatttttagagatgttatttttgtttttgttgttatttttgttttttagagattataaaagtgatatttaagaaaaattaatttgttaacggtatataaatggaaagaagtggaagagtaaagattttagagatttgttattttagaggtataggtattatgattgtaagaaaaattttggtttttgttttgattttagggagttgatatttaatattatttgaattttttttgttgagtttatagtttttttttttttttttttttttttttgagatagagtttttttttgtcgttaggttggagtgtagtggcgcgatttcggtttattgtagtttttgatttttcggtttaagtgatttttttgttttaggttttcgagtagttaggattataggtatacgttattacgtttagtaaatttttgtatttttagtagagtcggggttttattatgttggttaggatgatttcgattttttgatttcgtgattcgttcgtttgggatttttaaagtgttggggattataggcgtgagttatagcgttcggtttgagtttatagttttttaaaatttgaatttagttattttttatgtggaaaagaatgtatttagtagttataaaagtaatttgttttattatatatatagtaattgggtgtgtggaaaaaattagtatttgtttttttttagtataaatagtaagaataattttttttgatagtgtaatttttttgtttaaaggttttggagttttttaaagttatcgtggtattaaagattattggaacgaatatatatatatatatatatatatatatatatatatatatattattatggtattaaagattatttaaaaatagtttttttttttagttattatggaattagattattttaatacgcgcgcgtatatatatatatatttatgatattaaagattatttaaatacgtatacgtacgtatatatattttaagttatcgtggtattaaagattattttacgcgcgcgtgtatatatatatatatattatggtattaaagattatttatatatacgttttttagataggttttttttttttttttttgagacggagtttcgttttgtcgtttaggttggagtgtaatggcgcgatttcggtttattgtaattttcgttttcgggtttaagcgatttttttattttagttttttgagtagttggggattacgagcgcgcgttattacgtttagttaattttttgtatttttagtaagagacggggtttcgttatgttggttaggttggtttcgtattattgattttaggtgattcgttcgttttggttttttaaagtgttgggattataggcgtgagttagttagttcggtttttagataggttttttaaaagttttaattattaatttttttagaaaggttattaattttacgggtaaagtaagatttaggttttgacgaattaagattgatttgtttgtattttgtaatagttattgattataaataatatttttaggtatttttttattttttggttatttttcgtttttttttattttgttttttttttttattttcgaggtagtaaagttcggggaggttcgggagcgtttgggttacgtgtgcgtacgcgcggttgtttagaggcgttgttgtagggaggcgggatagagtttcgcggttcgtacgtggtcgcgagtttacggtttgggggttagggagatcgtgaagggttcggatttttgttatttatttttacgtgtcgttattattttaagtgggttgagggttgcgatcgcgtcgggaagcgaggtagaattttagaaaagaggggtggttagagagttcgttgggcggggaaggaggcggggtcgcgcgattttgcgttatttttttcgagttcgttatagtcgtttaattcggaggggtatgggcggagattgaaacgcggatatcggacgaaataacgttttattggtttttcgtcgtaggcgtagagacgcgatttcgttttcgggtcgtttcgttggcgtagtgttcggataggcgaaaagtgcgcgtattggcggtttttttttattttgcggaagttcgtatatttcggttttttttcggttgcgggagcgatttagaagttggagcgtattaagttttgacggtttgggggaagtatgtagggaagggtatatgaaggttaaatgttttgaaagagaaatgaggttaagttcgttatttttattacgttattgttgggtgttggaaaataacggagatttttacgtgtagtaaatatagttttttaggtagtttttaggggaaggttagttttattttatagtattcgtgatttcgttttttagtcgcgggatcgtttttgcgttttcgttcgttggtggattcggagggggaggagtagggttgagttgttacgttatttagggagtagcgcgcgtcgggcgtagtagttggggttattttcgggaaggaagagtttgtgcgagcgtagtttttgagtcgacgggtcgagttggtagttggttggtgtttatattttgcgcgtagcggtaggtttttttacgtgttttcggcggcgatatggagttggaggagttggggattcgagaggaatgtggcgtgttcgggtgtatcgttttaggagagtggtttacgtagttggatgtatcgtatgtgattattttgggattcgtggggttgtagtatcggtgagtaatagggtgggggtggcgggggcgtgcgtttttatttttcggagttagtttttcgtagtcggcgtttttatgagcgtttcgagggttcgggagatcgattttttcgatttaagttagtatttgtttgtggcgtcgatttgggttgtttaggcgtgtacgaggggtattcgtttttatgaattttagtttgttttgtttatttttttagttatttatgttttttaggggtttttttttttttcgtttttcggttgtgtgtacgtatttagaggttggttagtttcgtaaatcgtcggtttgtttggtttagttgggttagggttttttttcgattgtaggcggtgtttagtttttcggagtttgtgcgtgtttttgtaataggttagtgtggcgtgtcggtagtttaggttttttaatagttaaaggttttcgcgcgcgcgttcgaattattataattttttgtttgtaatcgtagaggtatttgagtagattattcgtttgaaagtagttatagttatcgtaagttgaggatggtatagtttatatttatcgaagtagtcgtcggggagttcggaatttttatttatttgtgagatatgtttgtcgtttttaagttttttaattgtaatatttaattttagattatgattaattttgcggtataatttaaagattatttttaatgtaattaaaatgttaatgtgtttataattttataatttaaaaatgtaaagaataattagtggtattgtggaaagtatatgggaagagggtgaaaattagggagttcggtaaagaggttatattaatattttatatgagatatgatgaagttttggttagttataatgagaatagagtagagagaaaattttatgtagtatgttagtagattttttaaagatttagtgattgattaaaaattaaggatattttaaatgtttttgtataagtgattggaaatatagtgatgttaaggtggaagtaatttgtaggaggattaaatttaggttagatgtggtggatcgtgttttatttcgggaagtcgaagtaggagaattttttgaatttaggagtttaagattagttagggtaatatggtgggaaatttattttataaaaaattagttaggtatggtggtttatattttatagttttagttatttaggaggttgagttgggaggattatttgagttttggaagttgaggtagtaatgagttaagattatattattgtattttagtttgggtgataggagtgaaattttttttttaaaaaaaaaaaaaaaggtgatgggagaatagagagtttgattttggaattgggagtttgaggtaattaaacgtgtatagttatgttgtaaggatagtttttttgtttatgagtgaaaacgaaggagtttggagttaagggagtatttgaaagcgttgaagatttttttaagaagttgagatattggtatttatatttttattagattaatttttggttaaaatcggggatttttagaagttaagtgatttatttatttattaattaatatttaaagtatttaaataatgaagagtcgaaggtgtttaattgaataaaataatgcgattgttgtttaatatggtaataattgtaaagtttttttagaatttggtgttattttagaaatggaaagaatgtaggtagggtggattttttttttaatgaaatgatttgttattgagttgtaaatatgaaaaatagttaatttaagttaattagttgtaatttttgtttttttaattttatttatatttggtatttttattatattatttattgtttttttttaggtgttaaatttatttgtagttttgttttttttgaggtttcgtattattaaacgtatataatttagtgttttgtttatggtatatatagatagtgggtattatagatttttgaataattttgtttttgaaatagtatttataagatttagattatggtagatattttattattgttattgatttttttttttttgtttattaatgtttttatagataatgagtagattttatgtaaatagtgttgggtttaataatatagtacgttaagaaatttttgtaaattatttagttttagattattttatgtattaaatttttattatattttattgttaaaatggagttgtttttttttattgttaaaatggagttgtttttgtaaataagtaatgaaatagtgtagaatagttattttaaatgtgtttttatttataaatttaggaaaacgtaaattaaataaaggagaaagtttttgtttggagttgtggaaaaatattagttgagtaatgtttttgatatttttttttttatttattatttttataaaattaaaatttaaattatttttagaatttaatttatattttaaaaatatattatatgtagttggtattagtagttagtgttattgtaatgtgttttttttgtattttatagatttttttaaagtggtaatatttaatttttttttaaaaaaatttttaattttgtgtaaaatagtataataaattggttatttttttatagttttgatattttagtttatatttattatatggttatagaagttttgaatttttatagtttataaaattgtaaaataaaagaaaaataagagtatttttttttttttttttttttttttttttttttttatttttagtggtttttggggttgtatttgggttgagcgtttttaggtatttgttatttgtatttttttttgtaaattgtgtggtaggtttatattgtaggattatatttaaattatggaagaattttatagttttagagttgtttttagagttatgggtatatttaattgttttatatttatatttgagatttttgtatttagtttagtattgtttttagtttttgtatatttttaatgattgtagttttttagtaatgtaaataaatatttttttattttttagtgttttataaagttgttttcgtatatttttttttgtttagatatttagtaaagttttaattttttttttagtttagtgtttttttgttttattttttatgttgaaagtgatttggaaatgatttattatttttagttaaggttttgttttttaggaaattatatggttggttgttaataagtttcgaagagttgaaaggatgtagtttaattggtttaagttgtttgagggagtaatttgagaaattgttaaataagtaggttttgtgattaaagaagtttggatttaaatgatttttaattatattattttagtttgaaggaaaaattttttttgagataaaagggaaagaaaatcgttttttgtgtatttttttttttatataatttattgttttattaaatgattgttgatttttaaaaattgttttgaaaatggttggtagaggttttttttaagaggtttatagttaatgttaataatatattttttttgatatgaattatttagttttttaatattggttaatttatagattttatagtattttattaaataaaagaaattataagttaatttatttagttttatatggtatatagtattatgtatatttatttttagtatttaatgtatttaataaaattattttttgaggttgttgtgagttgtgattatgttaagtttttttagagttttatttggtaatatatttaatgttgttatttttttcgttaataaaatattgtaataattgtaatatataattttgaaaaaggtttttttttattaaataaattaatgtattaatagttattaaagtttataggtatatatggaagaggtttattttttgtttttattttgatatatattttttggaataaaaattggttaataaatatttattatttatagtatttgtttagaattattaaaaatggtaaagtagttggaatttttatgagagtttatattgtatagtggtatggatgtttttagtttttattatgttttgttttatttttagtttagattttggtttttttttttgtattattatttaattaatattaatgtaggaaatgagatatagatatgggaaagggtgtttggttagtagagggtttttagaaataaaatttttttttttaatagtaaaagtgttatttattggagaatatttggaaaatgtagaaaggtataaaaaatggttattaattatgtattttgtttttattatatttggagattttaatttatatttatatatttattttgttgaaattttatttaggggttataaagagtagaggttagaagtataaattttgtagttggattgtttgtattggaattttggttattatttgttgtttgtgtgataatgggaaagtaattttttttttattgttttagtgtgtttatttgtaaaatgggtatggtaattatagtatttattttataggattgttgtgaaaattaaattatattacgtatgttatcgatttaaataattaaaaggattagaatttaatttagagagagtttatttaagtattaagtttgaggatgttttatttagaaatattaattttaaggaatggagttagtattgtaaagtaggaaagttaaggttttatttttataggtagatagaggagtttttagtagaattataatattttttatataaggttagcgcgtttagttatagtagtttgattgttataggtggtggtttttttggggagggtatatttaatatttttttatagaggatgttaatgggtttttttttatttggtttagtaaagtaggataataaaataaaagttaattttttttttttttttttttgaaacggaatttcgttttgtcgtttaggtcggagtgtagtggcgcgattttagtttattgtaagtttcgttttttgggtttacgtcgtttttttgttttagttttcggagtagttgggacgataggcgttcgttattacgttcggtttattttttgtatttttagtagagacggggatttatcgtgttagttaggatggtttcgattttttgatttcgtggtttattcgtttttatttaggagttaatttttaataaagtttattatttgagaaggtaggaggttattgtttttgatgtttttttttttttttttttttgagacggagttttcgttttgtcgtttaggttggagtgtagtggtgcgattttggtttattgtaatttcgtttttcgggtttaagtaatttttttgttttagttttttgagtagttgggattataagcgtgtgttattatggttagttaatttttgtatttttagtagagatagggttttattatgttggttaggatggtttttagttttgattttgtaattcgtttacgttagttttttaaagtgttgggattataggcgtgagttatcgtattcggttgtttttgatgttttttaattttttttagttattgtatagaataagaaaaataagaaagtgagttaatttataatttgagaaatagaagttgtaattatatgtgatttggattatagttatattttttttaaggtttaaagtatatttggggttttaatagtttttaaattatttatttttataacgtaaaatgttaggatagattgtttggtatgttagttaatattagatgagatatttaattgttatattgttatttgttgtgattgttaattattagtattagtattattaatagaagtagtgttagtataagtagtatttaatgtgttgttatattaagtttatggatgtttgttgagaaagtatgtttgataaagttttttaagaagttaattaattggtagatttaatagttaatatttttttatatttatagg

SEQ ID NO: 118 - DNA, 11036 bp, Artificial Sequence
  chemically treated genomic DNA (Homo sapiens)
  unsure (9056, 9079, 9081, 9094, 9108..)
tttgtgaatataaaaagatattagttgttaaatttgttaattgattagttttttgaagaattttattaagtatatttttttaataagtatttatgaatttagtgtgataatatattaaatgttatttgtattagtattatttttattgatgatgttgatgttgatgattagtaattatagtagatgataatgtaataattagatattttatttaatattaattaatatgttaggtagtttgttttagtattttacgttgtaaaaataaataatttaaaagttattggaattttaaatatattttaggttttgagagagatatgattgtgatttaagttatatatggttataatttttgttttttagattatagattaatttatttttttattttttttgttttatataatgattagagagaattaaaagatattagagatagtcgggtacggtggtttacgtttgtaattttagtattttgggaggttgacgtgggcggattataaggttaaggttggagattattttggttaatatggtgaaattttgtttttattaaaaatataaaaattagttggttatagtagtatacgtttgtagttttagttatttaggaggttgaggtaggagaattgtttgaattcgggaggcggagttgtagtgaattaagatcgtattattgtattttagtttgggcgatagagcggagatttcgttttaaaaaaaaaaaaaaaaaaagatattagaaataataattttttgtttttttaagtgatgagttttgttaaagattaatttttaggtggaggcgggtggattacgaggttaggagatcgagattattttggttaatacggtgaattttcgtttttattaaaaatataaaaaatgagtcgggcgtggtggcgggcgtttgtcgttttagttatttcggaggttgaggtaggagaacggcgtgaatttaggaggcggagtttgtagtgagttgagatcgcgttattgtatttcggtttgggcgatagagcgagatttcgttttaaaaaaaaaaaaaaaaaaagttagtttttgttttgttgttttgttttgttagattaaatgaaagaaaatttattaatattttttgtaaaaaaatgttaaatgtattttttttagaagaattattatttataataattaaattgttgtaattgggcgcgttaattttgtataaaaaatgttgtgattttgttaaaaatttttttgtttgtttatagaaatgaaattttaatttttttattttgtaatgttgattttattttttggagttggtgtttttgggtgagatatttttaaatttggtgtttgaataaattttttttaaattagattttgatttttttaattatttaggtcgatagtatgcgtgatataatttggtttttataataattttatgaagtaggtattatgattattatgtttattttatagataaatatattaaagtaatagaaaggaagttatttttttattgttatatagatagtaggtggtagttaggattttaatgtagataatttaattgtagaatttatgtttttaatttttattttttataatttttaaatagggttttaataggatgagtatgtagatgtaaattaaaatttttaaatataatagaggtaaaatgtatagttggtaattattttttatgtttttttgtattttttaaatgttttttaataaatagtatttttgttattagaaaaaaaaattttgtttttgaaaattttttgttgattaggtatttttttttatgtttgtgttttattttttgtattagtgttgattaagtggtgatatagagaaaaaagttaaaatttagattgaaggtagggtaagatatagtaaagattaagagtatttatattattgtgtagtataaatttttataaaggttttaattgttttgttatttttaatagttttgaataagtgttataaatagtagatgtttattgattaatttttgttttaaagaatatatattaggatagaaataaaaagtaaattttttttatatgtgtttgtagattttagtagttgttaatatattgatttatttggtaaaaaggaattttttttaaaattatatattgtaattgttgtagtgttttattaacgagaaaaatgataatattaaatatgttgttaagtaaaattttaaaaaaatttggtatgattatagtttatagtagttttaagaaatgattttattaaatgtattaaatattgaaaatagatatgtataatattatatattatatgggattaaataaattgatttatgattttttttatttagtgaaatgttgtggggtttgtaagttaattaatgttagaggattaggtgatttatgttagaggaaatatattattaatattggttatagattttttggaaaaagtttttgttaattatttttaaaataatttttaaaaattaataattatttggtaaaatagtaaattatgtaagaaaagaaatatataaaaaacggtttttttttttttttgttttaagggaagttttttttttaggttgaaatgatatagttaagaattatttagatttaggtttttttaattataaagtttgtttatttggtagttttttaagttatttttttaggtagtttgaattagttaaattatatttttttagtttttcggagtttattgataattagttatgtggttttttaggaaataaaattttggttggaaatagtgaattatttttaggttatttttaatatggagagtggagtaggaaagtattggattgaggaggaggttaaagttttgttaagtgtttgggtagaaaaaaatatacgaaaataattttatggaatattaagaaataaaggaatatttatttatattgttaaaaggttgtaattattaggagtatatagagattggaaatagtgttgggttaagtataaaaattttaaatatgaatatagaatagttaaatatgtttataattttggagatagttttaaaattatgaagtttttttatgatttggatgtaattttgtagtatgaatttgttatataatttatagaggaagatgtaaatggtaggtatttggaaacgtttagtttaagtatagttttagagattattgaaggtaaaaaaaaaaaaaaaaaaaaaaaaaaaaagaaaagtatttttgttttttttttgttttatagttttatgaattgtaaaagtttaggatttttgtggttatatgataaatatagattgaaatattaagattgtggaaaaataattaatttattatgttattttgtataaggttaagaatttttttaaaaagaggttaaatattattattttaaaaaaatttgtaaaatatagaaaaagtatattataatggtattgattgttagtgttaattgtatgtgatatgtttttgaaatatggattgagttttaaaaatagtttaagttttaattttataagagtggtaaataaggggaaaaatattaaaaatattgtttaattgatgtttttttatagttttaaataagaatttttttttttatttaatttgcgtttttttaaatttataaataaaagtatatttaaaataattgttttatattattttattatttgtttataagaatagttttattttaataatgaagaagaatagttttattttaataatgaagtataatgaagatttagtatatgaaatgatttgagattaagtgatttataggggttttttgacgtgttgtgttgttaaatttaatattatttatatagaatttatttattgtttgtggaagtattagtaggtaaagggagggaaattaatgatagtaatgagatgtttattatagtttaaattttatagatgttattttaagagtagaattatttaaaaatttgtaatatttattatttgtgtgtattatgggtaaagtattaagttatatgcgtttagtaatgcgaaattttaaaaaggatagaattgtaaataaatttaatatttgagagaaaatagtaaatagtataataaaagtattaaatgtgaatggggttaagaggataaagattataattggttaatttaagttagttattttttatgtttatagtttagtaataaattattttattaaaagaagaatttattttgtttatattttttttatttttgagatgatattaaattttgagaaagttttgtagttattattatattaaatagtaatcgtattattttatttaattaaatattttcgattttttattatttaagtgttttaaatattgattaataaataagtaaattatttagtttttgaaagttttcgattttaattaggagttggtttgatgaagatgtgggtgttaatattttaattttttaaagggatttttagcgtttttaggtatttttttggttttaaattttttcgtttttatttataaatagagggattatttttataatataattatgtacgtttagttattttaaatttttaattttaaaattaaattttttatttttttattatttttttttttttttttagagagagggttttatttttgttatttaagttgaagtgtagtggtgtgattttggtttattgttgttttaatttttaggatttaaatgatttttttaatttagttttttgaatagttgggattatggggtgtgagttattatgtttggttaattttttgtgggatgggttttttattatgttgttttggttggttttgaatttttgggtttaagagatttttttgtttcggtttttcgaagtgaggtacgatttattatatttagtttgaatttgatttttttataaattgtttttattttagtattattatatttttaattatttatatagaaatatttgagatatttttgatttttggttagttattaagtttttaaaaaatttgttgatatattgtataaaattttttttttgttttatttttattatgattaattagaattttattatgttttatatggaatattaatgtaatttttttatcgggttttttagtttttattttttttttatatattttttataatattattagttgttttttatatttttaaattataaaattataagtatattaatattttggttgtattaaaaataatttttaaattatatcgtaagattaattatggtttaaaattaaatattataattaggagatttgaggacggtagatatgttttatagatgagtgggaatttcggatttttcggcgattatttcggtgggtgtaaattgtattatttttaatttgcgatagttataattatttttaaacggataatttgtttaagtatttttgcggttgtaaataaaaggttgtggtggttcgagcgcgcgcgcgaaaatttttagttgttgaaggatttggattgtcggtacgttatattagtttattataggagtacgtataggtttcgggagattagatatcgtttgtagtcggggaggagttttgatttagttagattaagtaaatcggcggtttacgaagttggttagtttttggatgcgtgtatatagtcggggggcggggagggagagagtttttaaaaggtataagtggttgggagggtgggtaggataggttaaagtttatggaagcgagtgtttttcgtgtacgtttaggtaatttaggtcgacgttataggtaggtattggtttaggtcggagaggtcggtttttcgggttttcgggacgtttatgagaacgtcgattgcgggaagttggtttcgagagatggagacgtacgttttcgttatttttattttgttgtttatcggtgttgtagttttacgagttttagagtgattatatgcggtatatttagttgcgtgggttatttttttgaggcgatgtattcgaatacgttatatttttttcggatttttaatttttttagttttatgtcgtcgtcgaaagtacgtggaaggatttgtcgttgcgcgtaaggtgtaagtattaattagttgttagttcggttcgtcgatttagaagttgcgttcgtataggtttttttttttcgagggtggttttagttattgcgttcggcgcgcgttgttttttaggtggcgtggtagtttagttttgttttttttttttcgagtttattaacgagcgagggcgtaggggcggtttcgcggttgaggggcggggttacggatgttgtagggtggagttagtttttttttaagagttgtttggaaagttgtatttgttgtacgtggaaattttcgttattttttagtatttaatagtagcgtaatgggagtaacggatttaattttattttttttttagagtatttagtttttatatgtttttttttgtatgttttttttaggtcgttaagatttggtacgttttaatttttgagtcgttttcgtagtcgagaaggggtcggggtatgcgagttttcgtagagtggggaggggtcgttagtgcgcgtatttttcgtttgttcgggtattgcgttagcggggcggttcggaggcggggtcgcgtttttgcgtttgcggcgggaagttagtggggcgttgtttcgttcgatattcgcgttttagttttcgtttatattttttcgggttaggcggttgtagcggattcgaaaagagtggcgtagggtcgcgcggtttcgttttttttttcgtttagcgaattttttgattattttttttttttagagttttgtttcgtttttcggcgcggtcgtagtttttagtttatttaggataatggcgatacgtgagggtgagtaatagggattcgggttttttacggtttttttgatttttaggtcgtgagttcgcggttacgtgcgagtcgcgaaattttgtttcgtttttttgtagtagcgtttttaggtagtcgcgcgtgcgtatacgtggtttaggcgttttcgggttttttcgaattttattgtttcggggatggggagaaggagtaaagtagaggagaacgagaaatggttaaggggtggaaaggtgtttggaagtattatttataattaatagttattgtaaaatataagtaaattagttttgattcgttaaaatttgagttttgttttgttcgtgaggttaatgatttttttaagaaggttaataattgaaatttttgaaagatttgtttagaggtcgggttggttggtttacgtttgtaattttagtattttgggaggttaaggcgggcggattatttgaggttagtagtacgagattagtttggttaatatggcgaaatttcgttttttattaaaaatataaaaaattagttggacgtggtggcgcgcgttcgtaatttttagttatttaggaggttgaggtaggagaatcgtttgaattcggaggcggaggttgtagtgagtcgagatcgcgttattgtattttagtttgggcgataaagcgagatttcgttttaaaaaagaaaaagaaaaatttgtttagggggcgtgtgtgtaagtagtttttgatgttatggtgtgtgtgtgtgtgtgtacgcgcgcgtgaagtagtttttgatgttacgatagtttggggtgtgtgtacgtgcgtgtgcgtgtttaagtagtttttgatgttatgggtgtgtatgtgtgtgcgcgcgcgtgttgaagtagtttgattttatgatggttggggaggggggttgtttttaggtagtttttgatgttatgatggtgtgtgtgtgtgtgtgtgtgtgtgtgtgtgtgtgtgtgtgttcgttttagtagtttttgatgttacgatggttttgaagaattttaaaatttttaggtaaaaaagttgtattattaggaaagattgtttttgttatttatgttggaaaaaaataaatgttggttttttttatatatttagttgttatatgtatagtgaggtaaattgtttttgtggttgttgggtatatttttttttatatagaaagtaattgaatttagattttaaaaagttgtagatttaggtcgggcgttgtggtttacgtttgtaatttttagtattttgggagttttaggcgggcggattacgaggttaggagatcgagattattttgattaatatggtgaaatttcggttttattaaaaatgtaaaaatttgttggacgtggtggcgtatgtttgtaattttagttattcgggaatttgaggtaggagaattatttgaatcggggagttagaggttgtagtgagtcgggatcgcgttattgtattttagtttggcgatagagagagattttgttttaaaaaaaaaaaaaaaaaaaaaaaaaagttgtagatttagtaaaaaagatttagatgatattgagtattaattttttagaattaaggtaaggattagaattttttttgtaattatggtatttgtatttttaaaatggtaaatttttaaaatttttgtttttttatttttttttatttgtgtatcgttggtaggttgattttttttaaatgttatttttatggtttttaaaaggtaaaagtggtaataaaggtaaaaatggtatttttagagatgttaaatttagtttgtttagtttgaaatttttttttatttaaattttgaatattgttattttttttatttttttagttttaattttgattttttttttttgtgaatttttagttatgttttagttaggttaatttattaaagtttgttttttattatatatattttatttatattattttttttagaatattgttggttaatggaaatataatgtaaatttgttttttataagttatattttaaaaagtaaaataataaaaaaaattggtgtaatgtgtttttatatatatatatatatatatatatatatatatgtttatttttgttttttgtttttagtttgtttcgtatagatatattatttcgcgttcgatatatttcgattattgaatttttagaggcgatgtttttatttttcggttttagtttttnttatattttattagttttttttnanttttttatttttnttttttaatttttnnntttatatttttatttagtttttttttaattttatttattatattttatatttttttttacgttatcgttcgtttttttaagtttttttaatgttttaatattttttaaattttatcgatttttttacgattttttttttatttttatttaattatttattatttcgttataatttttttttttatatttatttttttttttattatattttacgaaatttatttatttttttttattttttttaattttttatattatttttattattttatttcgttttatttaattatatattttataattatacgtttaattacgtatatcgtttatatttttatacggaaaacgttaatgttatgttatcgaaggcgagttagtattttatttttagagacgggatttaagtttggcgggcgagattttttttatcgaagtcggtagattgtatttttttttttttatagttttaattttgataaattattttagagaattcgtagttgtgtgttagttaggttaatttattagagtgcgtgttgtacgagatatattttatttatagtatgtgttttagaagagtgttggttaatggagatttaacggtaggaggtttattgtgcgcggtatttttaaaagaaaaataataaaaaaaattggagtaatgtgtatatatatatatatatatatatatatatatataaaaggttttttttgttgttgttttttgtttgttttgttttgtttttgaaatggagtttcgttttgtgtggtttaggttggagtgtagtggtaagattttagtttattgtattttttattttttaggtttaagtgatttttttgttttagttttttaagtagttgggattataggtatattttattatattcggttaatttttttttgtattttttagtagagttagggttttgttatgttggttaagttggttttaaatttttgattttaagtgatttgtttgttttagttttttaaagtgttgggattataggcgtgagtttattttaatatattttatttaattttatatatataaaatatattttaatatggagttaagatgaaaaattttttagatattttataattttttatatcgaatgtagtatatattttaataaatgatattttaatttgtaatagttatatttttagtggttgttttattggatagtagagttttagaatttttttattttttgtgtaaattttgtgtttttttagatttttaaattttaattttatgaattatttttagtttttattaatttttttagaatttatttataaatttgtagtaattattttggtatttgtagggtatgttacgtatggttgttttttatgttgtttttatttattaatttaaattttttttttttttaatgattaagtaatatagatttaattaaattaaggggaggggtattagatataaattttgttcgggtttattgtatattaatatatataaatgttaatttttttatttgatttgggtattgttttttttgtttttgtttttttttgagacggagttttattttttgtttaggttggagtgtagtggcgttattttagtttattgtaattttcgttttttaggtttaagcgatttttttgttttagttttttaagtagtaaggattataggcgtgtattaatatattcggttaatttttgtaattttagtagagataggattttattatgttggttagtttggttttgaatttttaattttaagtgattcgttcgtttcggttttttaaagtgttgggattataggtatgagttattgttttcggtttattgttttttattttttttttttttttattttttatgatgaatttttaaagttattattttaaatattttgtatttttgtttattattttttt

SEQ ID NO: 119 - DNA, 7004 bp, Artificial Sequence
  chemically treated genomic DNA (Homo sapiens)
gttgaggcgggaggattatttgagttggggaggttggggttgtggggagtcgagattgtgtttttgtattttagtttgggtaatagagtgagattttgttttaaaaaaataaataaataaaaaataaataaagtttttattttttttaggatttttattttttatattaatttattgttttagtttggaggggcgggattagtttcgagtcgtagttgatttttagagtatagagtataggacggaagtggttttgtatggggtatagtgaggttagggaatagtaatgtatttttgttcgtgagttttggttattaggttttggggtggttttatcgaatttttattttaagtttcgtttaatagaaatttaggaaatgggtcggagaggttgggagattatttaggagattagttcgaggtcgcgttttggatttttgagtttttatttttgtaattaagataataaatttgtgttggttgtgcgggtatatatttgttattttagtattttgggagattaaggcgggtagattatttgaggttaggagttcgagattagtttggttaatatagtgaaattttatttttattaaaaatataaaaattaggttgggtgtggtggtttataggtggattatagggtggtttgtaattttagtattttgggaggttaaggagggtagattataaggttaagagatcgagattattttggttaatatgttgaaatttcgtttttattaaaagtataaaaattagttgggtatggtggtgggcgtttgtagttttagttattcgggaggttgaggtaggagattcgtttgaatttaggaggcggaggttgtagtgagttgagattacgttattgtattttagtttgggcgatagagcgagacgtcgttttagaaaaagaaaaaaataaattaaataaaaaaataagaataaaaatataaaaattagttaggcgtggtggtaggtatttgtaattttaattatttaggaggttgacgtagaagaattatttgaattcgggaggtagaggttgtagtgagttaagattgcgttattgtattttagtttgggtaatagagtgaggttttattttttttaaaaaaaaaataaaaaaaaaggaaaaggaaaaataaatttatggaattgtttatggggaggagggacggtttggttttgttatttatgttgacgaagaagtaaattgaggtacggttttttttttttttattagaattgaaaggtgtttgaggttttagtaggttttttgtatgagattcggtggttttgagggttttagatgtttttattttttttttcgttttttttgttaggtttagagtattatttttaaaatggtaattagtaaattaacgtgattttcgtataaaggtaaggtgagtttgtttttcgtttattttgaattatttatgaaggaggtagttggtttgcgggttgggatgggagataggagaggagaaaagatagaggttgggttttgttcgttaaataaattaggtgtttacgggagtttttgggcgttttttcgcgttggcgttttgtatatgatagttgatttgtaaattgttgggtttttagttatggttattgttaggttagtttaggaaggatattggttttaggtgatttgggtgaggtggaggcggtggggggggtttttgggattaggtcgttattgtaaaaataaacggtttgtttgtatttgttatcgttttttaagttttaggtggtgggtggggttgaggggttgagaggtggttttaaagaaagataattatattttaaattttggaattcgtgaataaggttttatttggaatattagtttttgaaggtattattaagtgttttgagatgagattattttggagtttgtaggtagattttaaatttcgcgatatatattttattttttatttttatttttttttttgagatagcgtgttattttgttgtttaggttggagtatagtggcgtaatttaggtttattgtaattttcgtttttcgcgtttaagtgattttttcgttttagtttttcgagtagttgggattataggagtaaattattacgttcggtaaatttttgtatttttagtggaaacgggtttttattatgttggttaggatagttttaggttttttattttgtgattcgtttgtttcggttttttaaagtgttgggatgataggtgtttattttcgtttttgttttttagagatagagttttatttttgttgtttaggttggagtgtaatggcgtaatttcggtttattgtaattttcgtttttcgggtttaagtgatttttttgttttagttttttaaggagttgggattatagggtatgtattattacgtttggttaatttttgtatttttggtggagaggaggtttttttatgttggttaggttggtttcgaattttgattttaggtgatttatttatttcggtttgttagagtgttgggattataggtgtgagttattgtattcggttagatattgttttaaaaaaataaaaataaaaaaaggtattggataggtggttggttatgtggggtttgcggggtaagggatggttttgggtttatattttgagtaagataggaggtttggcggggttacgattagaagtgggttttaatacgatttcgaagggttagattggtgtttggaatttggtggtttttattgttgttagttgttatttagattttcggtcgtttttgtttgtttgtttttagggcggggtttattttaggtatttcgcgaatagatagaagcggttggttttggtggtgtgaggatgggggtttttaggggagtaaatttatagtaatatattgggttttttttagatttatcggatatttttgatgagtgattttggttgtagatggtttttggtgagttttcgttgatcgggtggttcgggttaaaggattttgtcgtgcgatgtttttatggagttcggcggttatttttaattcgggttggaattttttggtattagacgttcggcggggttttaaggtttttgggtttacgttaggtttcggtttgaaacgtagtattgttggaataaaatacgttagagaagtagggcgttaggttcgtttggatttggggaaacgagaattgttatgtttttttttttcgtaggttggtgttaatgaaaaattttttttttagtatggattaaatttcgttaattttatttagggagtagtgtttatttcgggtcgggaattgtttcggtttttaatcgtagtttttcgtgagggttttagtgtggagggtcggggttatttttttattttgggatggtttttaattcgttgatttggttttttcgttaggtatttttatagttttgttagattttttatgtgattagcgtttttgggaatattagtttagggtgttttttgttgttgggatggtggttcgggagggatttttttggtgattttgttgggtttggtttttagtttttttagtcgtaggttggtagtttcgaattgtacgagttttaggttatagtttttttagttgtaggttagtgggttagggattgtagggggttcgggttttagtttttttagttgtaggcgggtggtttgggttttagtttttttatttgtaggcgggcggttttggattgtatggagttcgggttttagtttttttagttgtaggcggatggtcgtggattgtgtgtggtttgggttttagtttttttcgttgtaggtagatggtcgtggattgtgtgtggttttggttttagtttttttagttgtaggcggatggtcgtggattgtgtgtggttcggattttagtttttttagttttaggcggttggtcgcggattgtgtaaagtttaggttttagtttttttagttgtaagcgggcggtcgtttattgtataaggtttaggttttagtttttttagttgtaggtgagaggtcgcggattgtataaggtttaggttttagtttttttagttgtaggcgggcggttaaggattgtaaggtttaggttttagtttttttatttgtaggcgggcggtcgcggattgtataaggtttaggttttagtttttttagttgtaggtgagaggtcgcggattgtataaggtttaggttttagtttttttagttgtaggcgggcggtcgtttattgtataaggtttaggttttagtttttttagttgtaggcgggcggtcgcggattgtataaggtttaggttttagtttttttagttgtaggtagtcggtcgcggattgtgcggggttcggattttagtttttttattttcgtagtcgggattcgttgtttcggggcgaataaagaacggtcgggggtgatttcggattatggcgcgttcgtagtatttgtggttattgtggaaatagttttggcgtgttcgggacgcgacgcggttttttttttttcgcgcgattatttagatgtgagcgtttagtttgaatcggattttttggttatgtgtttataattaatatggagttttgagggttttttgttcgattttaagatggcgatgcgattttttttgtttttacggtttaggcgggcgggttttgtttatttgtaagatggcggtagtttgggtaaagtacgtttttcgtcgtttgattcgttacgtatttatttttaagatggcgtttttcgtaaagttacgcgttagttgattggtttagacgtcgttacgtgattttattttttttttttttttcgattatataagtcgttttcgttttcggttttgaggaataatcgttttttttaataggcgtttgcgatttttttgggtttcgttttcgggcggttttttggttagtgggaggtgttggcgggggttcgcggggtttttttcgttttttggttgtagcgggagttaatgggtagcgcgcgcgggggacgtgtgcgggcgttttcgttattttgtgagtttataattcggagtcgttgggtcggtttttgttatttcggcgtttttatttcgtttttcgcgggtttgttttgtgtgttatggacgggtgagtcgtacgtcgtttcgcgttttatcgtttttttcgcgtcgtagttttgttttcgtcgtcgcgtcggttttttcggggtcgatttcgttttttttcgggcgggagggggcggcgggttttttttttttttttcgcgtggcgggcgcgggtgcggggcgggttaggggtttttcgggggtttggtcgcgtttttatttttcgttcggttcgttttcggttttcgcgcgtttcgtttttagcgtacgcggtttttcgcgttttttttttttcgcgcgcgttttcgtatttcgtttttgtttcgtttcggcggcgcgcggtttttttcgtttttcgttcggttttcgcgcgttcggatggtttttttcgtttttcgttcgtttttttcgtgcgtttgcgtagttcgtcgcgcgttttcgttggttttagcgcgcgtgcgcggtcgttatcgggggcgcgcgtttttttcgtcgttcggattttgttttcggcgtagtttcggaagcgtaggcggggttggggcggtcgtcgggagggaaagttggcgtcggggtttcgtcgcgggttcgagtttttgcgtttttcgttttatttttgtttttcgtgcgtttcgggtcgcggttaaggggtttcggtgatttcgggagagaagcggtcgtttcgagggtttgtttttcgtttcggggtcggaggggtttttttagggattttcgcgggcgtcgttatggggaggggttttttcggttttcgggtcggggtagttttttcgggcggttttgttgggcgggttttttttgggagaggtgggagttttttttagaaaggtcgtgtttcgtcgagcgttttttgcgcgaggttttttttgggaataggaagcgggagaggttggagatgtttcgtatttttttcgtttttttgagaagttttttttgggtttagttatttttaaaagtttgttaaacgtggttcgtgtagtttgtggtgttagaagaggcgtagttttagagtgggtttggattttttagtatgcgtgcgggtaggtgggttttgtagacggcgagacgagggtttttcgttttcggatttagtatcgcgggttcgggggtcgcgtattcgtttttcggagtgaggtaggaggttcggaggttgttttttcgacggacgtttcgagttatttagggtttcgtcgggagttgtagtggtcgggagaagtcgtggggagtttattgttgggttaggatttggtcggggttgaagggagggtttcggatagttcggttttttatttatttttttttcggggtgtttcgaggagggagagtcgggtcgggcggggttcgggttgattagtaattgaggttgtgttttggtcggtttgttaatttttattgacggtttttacggtcgttttttgtttttttcggtggatcgggttttattttgttgagaggtatttttttgggggtttatttttattcgggtggaagttttggtttaggtttgtgagtttgttagttttagttttttcgaggcgtttttaatttattggaaagtatatagtagtttttgaatttttttagcggtatttagtatttttcggggttttcgatgggggtgtttttgttttggaacgtgtggggtttggtttagaggtggggtttggggttttgttgggagggaggggcgttaaaggataatggtggtttttttttaagttgtagttaagtggacggtttatttttttgtttttttgagttttttttagcggggtttcgtgtagttagagggagttttgcggaggtggtagttgtagggatttacgggtttttttggttcggggatagttgggtgtttttgttgttgagtggttattaggttaacgttgttttttttttttttttttatagt

SEQ ID NO: 120 - DNA, 7004 bp, Artificial Sequence
  chemically treated genomic DNA (Homo sapiens)
gttgtagagagaaagaaaggagataacgttagtttggtggttatttagtagtaggagtatttagttgttttcgggttaggagagttcgtaggtttttgtagttgttattttcgtagggttttttttggttgtacgaggtttcgttagagaaagtttagaagggtagggaagtgagtcgtttatttgattgtaatttgaaaaggggttattattgttttttggcgttttttttttttagtaggattttaggttttatttttggattaggttttatacgttttaagataaagatatttttatcggaagtttcgaggaatgttagatgtcgttgagagggtttaagggttgttgtgtgttttttagtaagttggaaacgtttcggagaggttgaaattggtaaatttataggtttgggttagagtttttattcgggtaggggtgggtttttaagagggtgttttttagtagagtggagttcgatttatcgaggagagtaggaggcggtcgtggaaatcgttaataaaaattaatagatcgattagaatatagttttagttattgattaattcgagtttcgttcgattcgatttttttttttcgggatatttcggggggaaggtggatagaaagtcggattgttcgaggttttttttttagtttcggttaggttttgatttaatagtgagttttttacggtttttttcggttattgtaattttcggcgaggttttaagtgattcggagcgttcgtcggaagggtagttttcgggttttttgttttatttcgggaggcgagtgcgcggttttcgagttcgcggtgttgggttcgagagcggggagttttcgtttcgtcgtttgtaggatttatttgttcgtacgtatgttaaggggtttagatttattttagggttgcgttttttttgatattatagattgtacggattacgtttaatagatttttaaaagtgattgaatttaagaaaaattttttaggaaaacggaaagaatgcgaaatatttttagtttttttcgttttttatttttagggagggtttcgcgtaggaagcgttcggcgggatacggtttttttggagggggtttttattttttttaagggaagttcgtttagtaaagtcgttcggaaaggttgtttcggttcgagagtcgggaaggtttttttttatgacggcgttcgcgggggtttttggagaggttttttcggtttcggggcggaggatagattttcggggcggtcgtttttttttcgagattatcgaaattttttggtcgcggttcggggcgtacggggggtaggggtagggcggggagcgtagagattcgggttcgcggcgaggtttcggcgttagttttttttttcggcggtcgttttagtttcgtttgcgttttcggggttgcgtcgggggtagagttcgggcggcgggaaaggcgcgcgttttcgatggcggtcgcgtacgcgcgttggggttaacggggacgcgcgacgggttacgtaggcgtacgaggggagcggacgggaggcgggaagggttattcgggcgcgcgagggtcggacgggaagcgggaagggtcgcgcgtcgtcgaggcggggtaaaggcgaagtgcggggacgcgcgcggagggggaggggcgcgggaggtcgcgtgcgttagggacggggcgcgcgggggtcggaagcgggtcggacgggggatggggacgcggttagattttcgggaagtttttgattcgtttcgtattcgcgttcgttacgcggagaggaaggggagagttcgtcgttttttttcgttcgagagggggcgagatcggtttcggggaggtcggcgcggcggcgggggtagggttgcggcgcggggagggcggtggggcgcggggcgacgtgcgatttattcgtttatggtatatagagtagattcgcgggggacggagtggaggcgtcggaatagtaggaatcgatttaacggtttcgagttatagatttataaaatggcggagacgttcgtatacgtttttcgcgcgcgttgtttattggttttcgttgtagttagggggcggggagagtttcgcgggttttcgttagtattttttattggttagaaggtcgttcgggggcgggatttagagaaatcgtaggcgtttattgggggaggcggttattttttaaggtcgaaggcggaaacggtttgtgtagtcgggggagggggagaaaatgggattacgtgacggcgtttgagttagttagttggcgcgtggttttgcgggagacgttattttgagagtgggtacgtggcgagttaggcggcgggaagcgtgttttgtttaggttgtcgttattttgtaagtgggtaggattcgttcgtttgggtcgtgagggtaaagggagtcgtatcgttattttggagtcgggtaggaaatttttagggttttatgttggttgtgggtatatggttaaaaagttcgatttaaattgagcgtttatatttgggtgatcgcgcggggagggaaaggtcgcgtcgcgtttcggatacgttagggttgtttttatagtggttatagatattgcgggcgcgttatgattcggggttattttcgatcgttttttgttcgtttcggaatagcgaatttcgattgcggagatagggaaattgaggttcgggtttcgtatagttcgcggtcggttgtttatagttgggaaaattgaggtttggattttgtatagttcgcggtcgttcgtttatagttggggaaattgaggtttggattttatatagtaggcggtcgttcgtttatagttggggaaattgaggtttggattttgtatagttcgcggttttttatttatagttggggaaattgaggtttggattttgtatagttcgcggtcgttcgtttataggtggggaaattgaggtttggattttgtagtttttggtcgttcgtttatagttggggaaattgaggtttggattttgtatagttcgcggttttttatttatagttggggaaattgaggtttggattttgtatagtgggcggtcgttcgtttatagttggggaaattgaggtttggattttgtatagttcgcggttaatcgtttaaagttggggaagttgaggttcgggttatatatagtttacggttattcgtttatagttggggaaattgaggttaaagttatatatagtttacggttatttgtttatagcgggggaaattgaggtttaggttatatatagtttacggttattcgtttatagttggagaaattgaggttcgggttttatataatttaaggtcgttcgtttataggtggggaaattgaggtttaagttattcgtttatagttggggaaattgaggttcgagttttttatagtttttggtttattgatttatagttggggaaattgtggtttggagttcgtatagttcgaggttgttagtttacggttggggaaattgagggttaggtttagtagggttattaggagggtttttttcgggttattattttagtagtagaaaatattttaaattaatgtttttaggagcgttgattatatgaagagtttgatagagttgtgagggtgtttgacggggaggttaggttagcgggttgggagttattttagagtgaggggatgatttcggttttttatattgggatttttacgggaggttgcggttggaaatcggagtagttttcggttcggagtagatattgttttttaaatagaattagcgggatttagtttatgttgaaaagggggttttttattaatattaatttacggagggagaagatatgataattttcgtttttttaaatttaggcgagtttagcgttttgtttttttggcgtgttttattttagtagtgttgcgttttaggtcggggtttggcgtgggtttaggagttttggagtttcgtcgggcgtttggtgttagaggattttagttcggattaggggtggtcgtcgagttttatggaggtatcgtacggtaaggttttttggttcgaattattcggttaacggagatttattaagagttatttgtagttagggttatttattaggaatgttcggtggatttgggagaagtttagtgtgttattgtggatttgtttttttggagatttttatttttatattattagaattagtcgtttttgtttgttcgcggagtgtttgggatgggtttcgttttgaaagtagataggtaggggcggtcgggggtttgagtggtagttggtagtagtagagattattaggttttaagtattagtttaatttttcggaatcgtgttaaaatttatttttgatcgtggtttcgttaggttttttgttttgtttaaagtataaatttaaggttattttttatttcgtaagttttatatgattagttatttgtttagtatttttttttatttttatttttttaagatagtgtttggtcgggtgtaatggtttatatttgtaattttagtattttggtaggtcgaggtgagtggattatttgaggttagagttcgagattagtttggttaatatggagaaattttttttttattaaaaatataaaaattagttaggcgtggtggtgtatgttttataattttagttttttgggaggttgaggtaagagaattatttgaattcgggaggcggaggttgtagtgagtcgagattgcgttattgtattttagtttgggtaataggagtgaaattttgtttttaaaaaataaaaacgaaaataaatatttgttattttagtattttggaaggtcgaggtaggcggattataaggtgaagagtttgagattattttggttaatatggtgaaagttcgtttttattaaaaatataaaaatttgtcgggcgtggtggtttgtttttgtaattttagttattcgggagattgaggcgggagaattatttgaacgcgggaggcggaggttgtagtgagtttagattacgttattgtattttagtttgggtaatagagtgatacgttattttaaaaaaaaaagtaaaaataaaaaataaaatgtatgtcgcggaatttagggtttatttgtagattttaggatgattttattttaagatatttaatggtatttttaaagattggtgttttaaatgaagttttgtttacgggttttagggtttaggatgtggttgtttttttttggggttattttttagttttttagttttatttattatttgaagtttagagggcgatagtaggtataagtaggtcgtttgtttttgtaatggcggtttggttttaggaattttttttatcgtttttattttatttaggttatttgaaattagtgttttttttgggttggtttgatagtaattatggttgagggtttagtaatttataggttagttgttatatgtagaacgttagcgcgggaagacgtttaggggttttcgtgggtatttgatttatttagcgagtagggtttagtttttgttttttttttttttttgttttttattttagttcgtaggttagttgttttttttatgaatgatttagggtgagcgaggaataggtttattttgtttttgtgcgagaattacgttggtttgttggttattattttgaaaatgatattttgagtttggtaggagaaacgggggggggagtgaggatatttgaggtttttagagttatcgaattttatgtagagggtttgttggggttttagatattttttagttttgatgggggagggaagggtcgtgttttagtttattttttcgttaatatgagtggtagggttaggtcgttttttttttttatgagtagttttatagatttattttttttttttttttttttttgttttttttttgggggggatggaattttattttattgtttaggttggagtatagtggcgtaattttggtttattgtaatttttgtttttcgggtttaagtgatttttttgcgttagttttttgagtagttgggattataggtgtttgttattacgtttagttaatttttgtatttttatttttatttttttatttgatttatttttttttttttttgagacggcgtttcgttttgtcgtttaggttggagtgtaatggcgtgattttagtttattgtaattttcgttttttgggtttaagcgagttttttgttttagtttttcgagtagttgggattataggcgtttattattatgtttagttaatttttatatttttaatagagacggggttttagtatgttggttaggatggtttcgattttttgattttgtgatttgttttttttggttttttaaagtgttgggattataggttattttgtaatttatttgtgagttattatatttagtttaatttttgtatttttagtagagatggggttttattgtgttggttaggttggtttcgaatttttgattttaggtgatttgttcgttttggttttttaaagtgttgggatgataggtgtgtgttcgtatagttagtataggtttattattttaattataaaagtgagggtttagggatttagggcgcggtttcgggttggttttttgggtggttttttagttttttcggtttattttttggatttttgttgaacggagtttggagtgggggttcggtgaggttattttaaggtttgatggttaggatttacggataggaatgtattgttattttttggttttattatattttatgtagaattattttcgttttgtgttttgtgttttgggaattaattgcggttcgaggttggtttcgtttttttaagttgggatagtgggttggtataggaagtagagattttaaagggaatgggggttttatttattttttgtttatttatttttttgaggtagggttttattttgttgtttaggttggagtgtagaggtatagtttcggttttttatagttttaatttttttagtttaggtgattttttcgttttagt

SEQ ID NO: 121 - DNA, 14649 bp, Artificial Sequence
  chemically treated genomic DNA (Homo sapiens)
agaaggtttggaaattatcgttagattaatttaaaattataaagttttttagagtttatttattttttaagttatatgtttacgtgtaagtgtgtatttatttaaagacgtaagtgattaattttttttaatatataattaaggtttgagttttgaagatttttttttggagttttagtaaatttatttaatttaattggtttagatgttggggtgatttttttttttttgagacggagttttattttgttttttaggttggggtttaatggcgtaattttagtttattgtaagttttttttcggtgtcggggtgattatttttattttgtttttcgttaagttatagaggtttggggagtttttttagatttttaataaatttgtttgtggagatttggggagtttttttagattcgtaataaaattggtttaattttaaatgggttttgttgagaattttttcgttatgggttgggtgcggtggtttatgtttgtaatttaaatattttgggaagttaaggtgggtggattacgaggttaagagatcgagattagtttggttaatatggtgaaagtttatttttattaaaaatataaaaattagtcgggcgtggttatgtatgtttgtaattttagttatttaggaggttgaggtaggagaattatttgaatttgggaggtagaggttgtagcgagttaagattttgttgttatattttagtttgggtgatagaggaagattttattttaaaaaaaaaaaaaaatttttttattattttgttatgttttaaggtttaggataggtttaggtaaaagttttgatggttttttgttatattttagtttttgtataagggtattggtttttagtatttaattttatttagtaattattgaaatagttgttatgaaagtttgtattagtgagatttggtttgttataggaggttgtagtgagttgagattttgttattgtattttagtttgggtggtagtgtgagattttgttttaaaaaagaaaaatgatgtagaaagatttgtttgatatagggtgggtataaatttttaatttgtaaaaaatatagtatttgtgaagtataataaaatgtagtgcgataaaatgaggtatgtttggatagtaaaatattatgttgtatttagtaaatgtatataatttttatttgtgaattatattttaataaagttggataaatgaattgtatttgtaatatggtagggaatatatgatattggatattaatgtaaatggaatttttagtgttttggtgaaaatgttatattattgaataaaaaaaaaatgtagtgtaaaatgaagtaaaatgtgaaaatttttaataaatgtagaaatatgaattgtttatttaaaagagaaaagttttttgagttttttaagaagattttttttttggatgttgggcgcggtggatgtcgggtatttgtattcgagtattttgggaggtcgaggtagatggattattggaggttaggagtttaagattagtttgtttaatacggtgaaatttcgtttttattaaaaatataataataattcgggtgtgatggtatgtatttgtaattttagttatttaggaggttgaggtataagaattgtttgaatttgggaggtagaggttgtagtgagtcgagattgtgttattgtagtttaatttggattatagagtgaaatttcgttttaaaaaaaaaaaaaaaagaaagaaggaaaaagaaggttttttttttgggtattttttttcgatatatttaatataaatggattaatgatattatttttattaggtgagtatgtttgggtaagttgttttagtgtttatttttttggttttttttttttttttttttttttggagatagggtttttttttgttatttaagttggagtgtagtggagtgaatatagtttattgtagtttttaatatttagttttaagagatttttttgttttagttttttaaatagttgggattattggtaggtattattatgtttggttagtttttaatttttttttttttgtaagtatagggtgttgttatgttgtttaggtaggttttgaattattgggtttaagtgatttttttattttagttttttaaagttttggattataggtatgagttatggtgtttggttgttttttgttttttttatttgtaaaaattgaggataataatagtatttttataaagttggtggaagaatgatattaatataaatgaagtgttaatagaaagagttttggaatatagtaagtatttgttagttatggttattgttattaatatattttttaaggtaaatttgtggttttatttattatttgagatatatgatttttaagtttattagatttttttttttggtttttatttttaaattaattaaatattattattattattattttgagatagagtttgttttgttgtttaggttagagtgtattggtacgattttagtttattgtaatttttattttttaggtttaagtaatttaggtgttttagttatttaaagaagttgggattataggtatgtattattatatttagttaatttttgtatttttagtagagatagggttttaatacgttggttaggttggttttgaatttttggttttaagtaattagtttatttgggttttttagtgtgttgggattataggcgtgagttatcgtgtttggtttttttttcgttttagagataggaattttatttttttttataggttggagtgtaaaggtatgaatataatttattgtagtttttaattttgggttaaagggatgtttttttttttgtttttggagtagttgggttttagaattgtgtcgtaattattgatttttattaagatttttgttttattattttatttttttattaggttatttttatatggatatataaatggtattttaagtgaaagaaattaattatttaaaataggattttttattttaaattagattttttttatatgttatttttgttaatgtgggttatatatattggtaagtttagaattatttttttttttttttttatttatatttaatattgttgaaataaaataaaatgttgtttttttttttttagaaaggtaatatttgtttattatattaaaatttagaaaatatggaaaaataaaaaggataaaaaattatttataattaaaatagtttaaatttttagttaaaaatgttaacgtatttgatatttgtttatataatttagattgtaatgtttatataaatgtgagtttttaaaatttaaaaggtttttattattaaaaatgttttgttaaattttgttttaaaagtaagattttaatatttaaatttttaaaatagatatttttgaagatttggaaaatatagacggtttaaaatttttatattattattgttaaattttggtatgttttgttattttgttagtgaaatatatatagatttgggggggttatttttttttttttttttttttttttttgagataagggttttattttggtgtttaggatggaatgtagtggcgttattatagtttattgtaatttggaatttttggattcgagggattttttcgtttcgattttttaaagtgttggggttattagtttaagttattgtgttaggcgaatggttatttttatatatatagttgatttttgaataatatgggtttgaattgtttgggttcgtttataagtcgatagaaaatatagtattggaggggtttgtatatagagaggtttgattttttttttaagtgttttattcgtaggattgattgcgggatttgagaatgcgcggattttttttttttttttttttttttaggaagttttattttcgtttaggtttgagtgtagtggcgcgattttagtttattgtaattttcgttttttagttttaagcgattttcgtgttttagtttttcgagtagttgggattataggggtttatttttacgtttaggtaattttttgtatttttagtagagatgggttttcgttatgttggttaggttggtttcgaatttttgattttaggtgattcgttcgtttcggttttttaaagtgttgggattataggcgtgaattatagcgttcggcggaatgcgtggattttggtataagacggtggttttggaattaatttttcgtcgagatgattgtttaaaaaattgtaattgtttaaaatttaatatttgtggttttttttattatgtagttttaaatttttttttttttttttttttaaatttagacggagtttttttttgtcgtttagacggcgtaatttcggtttattgtaattttcgtttttcgggtttaagcgatttttttgttttagttttcggagtagttgggattataggcgttcgatattacggtcggttaattttttgtatttttggtagagatggggtttttttgtgttagttaggatggtttcgattttttgattttatgattcgttcgtcgtggttttttaaagtgttgggattataggcgtgagttattacgtttggtttttatttaataagatatgaatttaaaaatgtatgttttagtatttatatatgttcgatgtaacgtatttaattagttatttttagaaattttgttttaatttatacgtttattaaattggtttgagtgtttttttttttttaatgtattgcgtatttataatttagaataagtgattaaaacgtttaagagtttattacgtaaattgttatttgttggaaatttacgttttaggttgtggatattggcggtcgaaatttgatttcggtttgttaagatatttttagagtacgcggcgttgttaagagtttggtcgagtgtagttcgagcgtcgacgtcgttaacgtggcgtatattgttgacgtagtacgtaagttcgttatagtggtttttcgtcggttgcgtcgtaagttcgttatagtggtttttcgtcggttacggcgttgcgttattggtttgtaggcgttttttttttggaagtggcgattgttgcgggtttgagcgttggttttacgcgtttcgggagttaggttggcggcgcgatgaggcgtagtaaggttgacgtggagcggtatatcgtttcggtgtagggttttatttcgtcgtttcgataggtgagtgggtttcgaagagatcgacggtttcgatttggtcgggcggcggttcgcgttgtttaggcgttatggttttcgacggcgttgttttttggcgcgttttgttgaggcgtcggtcgttggcgtagttttgtgggcggcgtggttttgtaagcgtatgaagagttttggggggatagcggtgggcgggagatttttggcgtcggcgttttttttttttttcggtttgttttcgacgtttgttttcgacggtgttcgtttttgggtatttttggttcgggttttttggtcgatcgcgtatttcgtagtattcgcgcggtttagttttcgggggtttgggtattcgggtgttgtatcggcgggtttttttttattttttggatatatattttatatgttgcggcggaggtcgtatttttttggtttggaggaatttagtggggattgacgtagtttcgggtgagttttggcggttgcgtcgagtgataaggtaggtattttagcgcggatatttgtaatggttcgacggcgtaaatgatattgaaagtttttttgttttgagtatgaggtgtttgtcgttgtttttttgtaagggtttagttttatttcgttttttatatttatttttttcgttttttttttcgttcggaatattttggtagttgtttttgtttaaaaaaaaaaaattttaaagtttttataaatcgttagtatggtttgtaatttttaattttttttataaatgttttaagggtattttttttttttatatgtaaataatgtgatttattttggatttaataagattttagtaattggatttaaagagtgacggaagaagttattaaaggtggatgtgcgtagaattttgagttagtttgttttggtttgaataattatagtattgtcgtttataagttgggtatttggggttagttatattttttatttatagatggagttgtaatattaatagaatttgataggatgatttattttaaatatttagggtattgtttgatatatagtattaaatgttagttataagttattttttattgttgatgttaaaaggatattggcggggcgtagtggtttacgtttgtaattttattattttgggaggtcgaggagggcggattgtttgaggttaggagttcgtgattagtttggttaatatgttgatatttcgtttttattaaaaatataaaaaaagttagtcgggcgtggtggcgtatgtttgtagttttagttattcgggaggttgaggtaggagagtcgtttgaattcgggaggcggaggttttagtgagtcgagatcgcgttattgtattttagtttgggcgatagagggagattttaaaaaaataaaaataaaaataaaaaaaattcggaaatttacggatgattatgattataatagtagtataattgtgttttttatcgtaattaagtataggttattttattttgcgtttttagtagttttgtggatattgagatttgtagagatttaagatatttgtttagggttaaatagatagtgtagtagaattttggtagtgggtttgatttagttttttttgggaatagtggagtaagttatagtttatttttttagaggaggaggatagatatttatttgtatattgtaattttaaattgttagtatagtataaatatgaatgtgatgatagagtttaaaatagattttaattgagggtttttgtaatttttgaaattaaagattttaatttttgtgttattttattttttttgaggtggggttttattttgttatttagttggatgtagtggcgttatttcgatttattgtatttttcgtttttttagtttaagcgatgtttttattttagtttttcgagtagttgggattataggtgtatttattatattcgttgttttgttttgttttgtatttttggtagagattgggttttattatgttgtttaggttgtttttgaatttttgggtttaagtgattttttcgtttttattttttaaagtgttgggattataggcgtgagttattgtatcggttattattttatttttgagataaggtttttttttgttttttaggttggagtgttgtggcgggatcgtggtttattgtagcgttgacgttttgggtttaatttatttttttattttagttttttgggtagttgagattataggtatgtgttattatgttcggtttttttttttaatgtagagacggggttttattatgttatttaggttggtttttaatttttgggtttaagtgattttttcgttttggttttaagtgttgagattataggtgtgagttattttgtttagtttgatttttttttttttaaataagtttaaaaaaaaaaaaaagtaagtttagagtttttttgagatttttagtggggattttggtttttaaaagattaaaaattattggtttagatagaagttagaatgtttttttaattatataatttttttattaaataaagtggagtggtggtagaattttgaggattggttattatgatattttttttatatttagagtttttttttttttttaaatttaaagttatttatattagaatttggggattttagcggaatatggattaattagtgagtaattttggaatatgtgaagttattttgtaaagttaggtttgagtgaaatgataaaatagggtgttttggatagaaggtaaagaatggagggagaagaggtagtggttgtgaagaatatgaagaggttagtatttttttttagtttggtagaggttggttatttgtgaattgtttatgttttttagaatgtcggagttttggagtgtgatgatgcgtttgtatattatatttttttagttttttattgtgtttttatttgttagtttttttttgttttgttatttttttatttttttatatgtgtttttgtttttaaaaatatttttcgtttgtaatttgagtattttgggaggtcgagagattagtttgattaatatggtgaaaattcgtttttattaaaaatataaaaatgagtcgggcgtggtggtagcgtttgtagttttatttattcggtaggttgagataggagaattgtttgaattttggaggtagaggttgtggtgagtagagattgtattattgtattttagtttgtgtgatagagcgagattttgtttttaaaaaagaaaaaaagaaaaaaaaatataattttttttttagtttttttttttttagatggtttttgtttagtttttttatgttttgttaagttgattttttattttgtagttgatttttattttttaaagtttatttgatagtttttatttttatttatttgttttttagaatagggttttgttgtgttgtttaggttgttattaaatttttgggcgtaaatgatttatttatttttgttttttgagtatttaggattataggtaggtatttttgatagttgttagttgttttttttgttttttatagttatattttatatttttgagtaatatatatatatatttttgttatttttaatttttttttttttattttagatatttttttttttttttttttttttttgagacggagattcgttttatcgtttaggttggagtgtagtggcgcgatttcggtttattgtaaattttgtttttcgggtttatattatttttttgttttagtttgtagttgggattataggtattcgttattatattcggttaattttttagtatttttagtagagacggggttttatcgtgttagttaggatagtttcgattttttgattttatgattcgttcgttttagttttttaaagtgtcggggttataggcgtgagttatcgcgtcgggttttattttagatattttgtattggttattatgtttttttaaaattgtttttagatattttggtttgttttttatttttttagtattgttattgtagtttttgtttaaatgaatatttaatatttatataaatataaggtaaatatttttgtatttgaattgtttttgttgtgcggttttgttttttttggattgaataattgttttattttttggtttgtttgtatgttgtgttattatttgtttatttaaatttagtaatttatatttttaaatgtggttaaattggttatataattttattaattgtagtttaaaatattgattgattgattgattgattgattgtttgtttatttggaatatttttattaattgatttttttaattaggattggtttttttttttttttgttatatagttgtgtttttgggatttttttttattattagtttgagaattttttttattttttttttgagttagattttttgttttttgtattttatgttttttttatttattttttttgttttggtgtagtatagttttatttgttttgaggaaaagtagatgagaggtttttttgtttgtttgtttttgttttgggatagagttttgttttgttgtttaggttggagtgtagtggtatggttttagtttattgtaattttcgtttttcgggtttaagcgatttttttgttttagttttttgagtagtgggattataggtgtgtgttattatgttcggttaattttttttatttttagtagagatgggattttattatgttggttaggttggttttgaaattaatggtatgtttttaaaatgtttttatttaatttagttgattatttggttatcgaattttgagtttgaaataatttttttttcgtaattttgaaagtattgttttattttttagaagttttgttgttaggagttcgatgagatttttgtttttggtaatttaaaggttttttggaagtgtttttttaattgggaaatttattttttttagttttgtagtattttttgtattatttttttgattattttttattttttttttaatgacgtttatttgaaagttggagtttttttaattttttttttattttttttttttgtttgttttgttttttgagagatttttttatttttatgttttaggggaagaagattggggaatttatggtttagtatttagatttttttttattgttttgtataatcgcggtttttatttttgttgggattttatagatttggagttgattagatgggtttgttgagaatagttgattagatgggtttttggaggattttagggggagggagatttatttgattgtgtaagatgggcgatagagtgagattttatttgaattaaaaaaaaaatttagaattgtatagtgaaaaagtaggttataaatattaagttttggataattataattatatttttattttattgtgtaagatagagatgatgtggtattttttagggttttattgtttttgtttttagttttgtattagtttttgatatttggtagtttaagtgaatttaggtatttgtttatagtgatatttgttgttatgtaaagaagtattgtttgtattagatattgttttgtttatataatatgggttgtgtttttttttagttgtgtatttttaaataaggtatttatttgtttgagttttagtttttttgtaaagtgagtaggttagaggtaaaagattatatagaagaataatttgtaaagttgtttaattattttaagattgtttattttaataatatagttggaagtaaagaaggtaatggaattatttttttattatgttttggtattgtattttgaatttatttttttattttgaaaagggggaattggttgggtttaatggttgacgtttgtaattttagtattttgggaggtggaggaagttagattataaggttaagagatcgagattattttggttaatatggtgaaattttatttttattaaaaatataaaaattagttgggtatggtggcgtgcgtttgtagttttagtttgtattcgggaggtagaggttgtagtgagttgagatcgagttattgtattgtagtttggcgatagagtaagattttattttaaaaaaaaaaaggaaggggggaataagttttgtttttttacgtgttgttttgattgttgtgtattatttttgttaagattgttgtagttttttttttttttgagacggaggtttgttttgtcgttagtgttgggattgtaggtgttagtttggtattgagtaacgttttgtaatttaagtatataagttttttatttttttgtttatatttatttttaggtattttttttttttagatgcgattgtaaatggaattgtttttttaatttttttttttgattgttcgttgttggtatagtagtttttttttatttatagtattgttttacgtggttttatttagttgtgttattcgtggtttaaaaatattgaatggaagattatataaataaatattttatgagttttaaattgtaaacggttttgaataatatggtaaaaattttacggttttttgtttcgttttatttaggatataagttatttttttgttcgatatatttatgttgtatgtgttcgttattcgttagttatatattagttattttagttattagattagttgttggagtattgtagtgtttgtgtttaagtaatttttattttatttaaaatggtattaaagagtaagagtagcgatgttggtagtttatatatgtagagagaagttatatagtgttttttttaagtgaagaggtgagtttttttgtttttttttttttttggtttaaataatagaaatttatttttttatggttttggaggttagaagcggtagattagggtgttgttgttttggtttttgatgagggttttttttttggtttataggttggttggtattttgtttttatatggtagagggagagtattgtagttttattttgttttttattattattatttttttaatttatttttttattgataatttttgggtgttttttatagagggggatttggtagggttatgggataatagtggagggaaggttagtagataaataagtgaataaaggtttttggtttttttaggtagaggattttgtagtttttcgtagtgtttgtgtttttgattatttgagattagggagtggtgatgatttttaacgagtatgttgtttttaagtatttgtttaataaagtatattttgtatcgtttttaatttatttaattttgggtggatatagtatatgttttagagagtatagggttgggggtaaggttatagattaataagattttaaggtagaagaattttttttagtgtagaataaaatgaaaagttttttatgtttatttttttttatatagatacggtaattattcgattttttaattttttttttatttttttcgtttttttattttataaaatcgttattgttattatggttcgtttttaatgagttgttgagtatattttttagacggggtggtggtcgggtagaggggttttttattttttagtaggggcggtcgggtagaggcgttttttagaagaggtgagtttttgatttaggaaagaaaaaagattatatattggagttgttaagatttatggtaagaataaattttttgtttatgaaattgtgaagaaggaaaaagaaatttgtgttagttttgttgtgatattttaaattgtaaaagttatagttatagtgtgtgataagtgtttagttgagatggataagatattaaatttgtgggtggaggatataaataggaaatatgtttcgattgacggtaatttggtttgatattatttatcgttttggatatttattggggttttggaattttaaaaataagatgtttgagtagttgtatattttttattatatggatggaatatattttggttgtattagtattttttttttttttttttttgagatggaattattttgttgtttacgttggagtgtagtggtgcgattttggtttattgtagtttttgtttttcggatttaagcgattttttgttttagttttttaagtagtggggattataggggtgtgttattatgtttagttaatttttgtatttttagtagaaaggaggtttttgtatgttggttaggttggtttcgaatttttggttttaggtgattcgttcgtttcggttttcgaaagtgttgggattataggtgtgagttatcgtatttagtttggtgtgtattagtattttggattttggagtttatgtaattaaggagttaggttgtggatttcgtttattatttgaagaatttaatatttatttttgtttttttgattttttgattgtaaaatattgatttgatttgtagagagaatagtatatggattagggaatttttagtgttttaatagattttaagtatttatttatttttttttatagaggtttatatatggtaggaaaagagatttttggaatattttttttttttaaagaaagttggttttttttgtttgttaagtgagagagtggtattatagggtttttaagatttttaaggttgatgaaaatttttttgttgtttgtttgttttatttttttgaatttattttttgtatgttatgtatttattatttagagagaggatttttttgtgttatttacgttggagtgtagtgttatagttataatttacggtagtgttaattttttgggtttaagtgattttttttttttggttttttgagtagttaggaatataggtatgttttattatgtttggttatttttttttttttggagataggattttgttgtgttgtataggttggttttaaatttttggttttaaagttagttttttattttggtttttgaaagtgttagaattaaaggtgtgattaattgtatttagtttatttatgatgatgatgatgatgatgatgatgatgatgatgatgatgatgtttgggagatggagtttcgttttgtcgtttaggttggagtgtaatggtacgattttagtttattgtaatttttggtttattgtaatttttattttttgggtttaattgattttcgtgttttagtttttcgagtagttggggttataggtatttattattatgtttggttaatttttgtatttttgttaagacggggttttattatgttagttaggttggttttaaatttttgattttaggtgattcgtttatttcggttttttaaagtgttgggattataggtatgagtcgttgtatttagttttattttttgttttgtgataggaaattataaaatatggaattatgtatttgttagtttttaaaaaaatttttaagtgaatgaaagtggcgtatttgaatattaatttaggatagatttttattatttttgaaaaaatgttggaaaatatttttgtatgaaaagtaaaataatttttaattttttttaga

SEQ ID NO: 122 - DNA, 14649 bp, Artificial Sequence
  chemically treated genomic DNA (Homo sapiens)
tttaaaaaaaattaaaagttgttttattttttatatagaaatattttttaatatttttttaaaagtagtaaaaatttgttttaagttgatgtttaaatacgttatttttatttatttaaaagtttttttaaaggttgataaatgtataattttatgttttataattttttattataaaataaaaaatagagttgggtgtagcggtttatgtttgtaattttagtattttgggaggtcgaagtgggcggattatttgaggttaggagtttgagattagtttggttaatatggtgaaatttcgttttgataaaaatataaaaattagttaggtatgatggtgggtgtttgtaattttagttattcgggaggttaaggtacgagaattagttgaatttaggaggtggaggttgtagtgagttagaggttgtagtgagttgagatcgtgttattgtattttagtttgggcgatagagcgagattttattttttaaatattattattattattattattattattattattattattattataaataagttgggtgtagttggttatatttttaattttagtatttttagagattaaggtgggaggttagttttgaggttaagagtttgaaattagtttgtgtaatataataagattttgtttttagggagaaaaaaatagttaggtatagtggagtatgtttgtgtttttagttatttaggaggttaaggaaggagaattatttgagtttaggaggttgatattgtcgtgagttatgattgtgatattgtattttagcgtgggtgatatagggagattttttttttaaataataaatatataatatataaaaaataaatttaagaaagtaagataagtagataatagaagaatttttattagttttggaaattttggaaattttgtggtattatttttttatttaataaataaaagaaattagttttttttggggaggaaaggtattttagaaatttttttttttattatgtgtaagtttttatgggaaagaataagtaagtatttaggatttattaaggtattgaggattttttggtttatgtattgttttttttatagattagattagtattttatagttaaggagttaaaaaggtagaaataaatattgaattttttaagtaataaacgaggtttatagtttggttttttggttatataaattttaaagtttaaaatgttgatgtatattaggttgggtgcggtggtttatatttgtaattttagtattttcggagatcgaggcgggcggattatttgaagttaagagttcgagattagtttggttaatatgtagaaattttttttttattaaaaatataaaaattagttgggtatggtggtatatttttgtaatttttattgtttgggaggttgaggtaaagaatcgtttgaattcgggaggtagaggttgtagtgggttaagatcgtattattgtattttagcgtgggtaatagaatgattttattttaaaaaaaaaaaaaaaaaaaatgttgatataattagagtatgttttatttatgtgataaagagtatatagttatttaaatattttatttttgaaattttaagattttagtgaatgtttaaaacgatgaatagtattaaattaggttgtcgttaatcgaaatatgttttttgtttgtgttttttatttataaatttaatgttttgtttattttaattaagtatttattatatattatggttgtaatttttgtagtttggggtgttataataaaattagtataaatttttttttttttttttataattttatggataaaagatttgtttttattatagattttagtaattttagtatatgatttttttttttttttaagttaaaaatttattttttttgaggggcgtttttgttcggtcgtttttattgggaagtgaggagtttttttgttcggttattatttcgtttgggaggtgtatttaatagtttattgagaacgggttatgatgataatggcggttttgtggaatagaaaggcgggaaaggtggggaaaagattgagaaatcggatggttgtcgtgtttgtgtagaaagaagtagatatgggagattttttattttgttttgtattaagaaaaatttttttgttttgggattttgttgatttgtgattttatttttaattttgtgttttttgaaatatgtgttgtgtttatttagggttaaatggattaagggcggtgtaagatgtgttttgttaaatagatgtttgaaggtagtatgttcgttaagagttattattattttttaattttaagtaattagggatataaatattgcggaaggttgtagggttttttgtttaggaaaattagagatttttgtttatttgtttatttgttgattttttttttattattgttttatgattttgttaaatttttttttgtgagaaatatttaagaattattaataaaaaaataaattaaaaaaataataataataaaaagtaaggtgagattatagtattttttttttgttatgtgaggataagatgttagttaatttataagttaggaagaaagtttttattaggaattaaagtagtagtattttgatttgtcgtttttagtttttagaattatgagaaaataaatttttgttgtttaagttaaaaaaaaaaaaaaataaaaaaatttatttttttatttaaaggaagtattatatggtttttttttgtatatgtgaattgttagtatcgttatttttgttttttggtgttattttaaataaaataaaggttatttgaatataagtattgtaatattttaataattgatttgataattgagatgattagtatgtaattagcgggtggcgagtatatatagtatgaatatgtcggataaagggatgatttgtgttttaggtaggacggagtaggaggtcgtgagatttttattatgttatttagaatcgtttgtaatttaaaatttatgaaatgtttatttatataattttttatttaatatttttggattacgggtgatatagttaagtaaaattacgtaaggtaatattgtggataagaagggattattgtattagtaacgaataattagaaaaggaaattaagaaagtaattttatttataatcgtatttaaaagaaaaaaatgtttgggaataaatgtaaataaggaggtgagagatttgtatgtttaaattataaaacgttgtttaatgttaggttaatatttgtaattttagtattggcgatagagtaagttttcgttttaaaaaaaaaaagaattatagtaattttaataaaaataatatatagtagttaggatagtacgtaaaggaataaggtttgtttttttttttttttttttttttgagatggagttttgttttgtcgttaggttgtagtgtagtggttcgattttagtttattgtaatttttgtttttcgggtataagttgggattataggcgtacgttattatgtttagttaatttttgtatttttagtagagatggggttttattatgttggttaagatggtttcgattttttgattttgtgatttgattttttttattttttaaagtgttgggattataggcgttagttattgagtttagttagttttttttttttaaaatgaagaaatagatttaaggtataatgttaaaatataatagaaaaataattttattattttttttgtttttaattatgttattaaagtagataattttaagataattaaataattttataaattatttttttatatgattttttgtttttaatttgtttattttataagggaattgaagtttaagtaggtaaatgttttgtttaaagatatatagttaggaaggagtatagtttatgttatgtaaataggataatatttgatgtaagtagtatttttttatatgatagtagatgttattataagtaaatatttgaatttatttaagttgttaaatattaagaattgatgtagggttgaaaataggaatagtaagattttaagagatgttatattatttttattttgtatagtaagatagagatgtaattgtaattgtttaaaatttaatatttgtggtttatttttttattatgtagttttaaattttttttttaatttagatggagttttattttgtcgtttattttgtatagttaaatgaatttttttttttttaaaattttttaaaaatttatttgattagttgtttttaataaatttatttgattagttttaaatttgtggagttttaataagggtgaaggtcgcgattatataggataatgaggaaaagtttagatattgaattatgagttttttaattttttttttttggaatataagggtaaggaaattttttaaaaggtagaataaataaaagaggagaataagagaaaaattagagaaattttagtttttaggtaaacgttattaaaaaaagggtaagaaatggttaaagaaataatataagaaatgttatagaattgaaagaaatgagttttttaattgaaaggatatttttagaaaatttttaagttattaagaataagaattttatcggatttttaataatagaatttttagaaaatggagtaatgtttttaaaattgcgaaaaaaaaattattttaaatttagaattcgataattaaatgattaattaaattaagtaaagatattttaaagatatattattagttttaagattagtttgattaatatggtgaaattttatttttattaaaaatagaaaaaattagtcgggtatggtggtatatatttgtaattttattatttaggaggttgaggtaggagaatcgtttgaattcgggaggcggaagttgtagtgagttgagattatgttattgtattttagtttgggtaatagagtaagattttgttttaaaataaaaataaataaataaaaaaattttttatttatttttttttaaagtaagtgagattatgttatattaaaataaagaaagtaaatgaagaggatatgagatataagaaataaagggtttaatttagaaaaaagatgaaaggaatttttaaattgatgataaagggaagttttaagagtatagttgtgtagtaaagaggaagaaaaattaattttggttggagaagttagttagtaagggtattttaggtagatagataattaattaattaattaattaattaatgttttaagttgtaattgatgggattatgtgattagtttgattatatttgagggtgtaaattgttgagtttaagtaagtaagtagtaatataatatataagtaaattaaaaaataaagtaattatttagtttaggaaaaataaaatcgtataataagggtaatttaaatgtaaaaatatttattttatatttatataaatgttaaatatttatttaaataaaaattgtaataatagtattgaaagaatgaggggtaaattaaagtgtttgaggatagttttggaggagtataataattagtatagaatgtttaaaatggggttcggcgcggtggtttacgtttgtaatttcggtattttgggaggttgaggcgggcggattatgaggttaggagatcgagattattttggttaatacggtgaaatttcgtttttattaaaaatattaaaaaattagtcgggtgtggtggcgggtgtttgtagttttagttataggttggggtaggagaatggtgtgaattcgggaggtagagtttgtagtgagtcgagatcgcgttattgtattttagtttggacgatagagcgagttttcgttttaaaaaaaaaaaaaaagaaaagaaaatgtttaaaatgggagaaaggaaattaaaaataataaaagtatatatgtgtgttatttagaagtatgaagtatagttgtaaagggtagaaaaaataattaatagttgttaaaggtgtttgtttgtagttttaagtatttaggaaatagaggtaggtggattatttacgtttaaaaatttgatggtagtttgggtaatatagtaagattttattttaaaaaataaataaataaaaataagagttgttaagtagattttgagaagtaggaattagttgtagaataagaaattaatttgatagaatatagaaaaattaaatagaagttatttggaaaaagaaaaattagagaaagaattatattttttttttttttttttttttttggagatagagtttcgttttgttatataggttggagtgtagtggtgtaatttttgtttattataatttttgtttttagggtttaagtaatttttttgttttagtttatcgagtaggtgggattataggcgttgttattacgttcggtttatttttgtatttttaatagagacggatttttattatattggttaggttggtttttcggttttttaaagtgtttagattatagacgaagaatatttttaagggtaaaagtatatgtgagggagtagaaaaatggtaaaataagagaagattaataaatgaaagtataatgaaagattagaaagatatgatatatagacgtattattatattttaaaatttcgatattttagaaagtatgggtagtttatagatggttagtttttgttaaattgggggagaatattaatttttttatattttttatagttattgttttttttttttttattttttattttttatttaaagtattttgttttgttattttatttaaatttaattttatagaatagttttatatgttttaaagttatttattagttaatttatatttcgttgaaatttttaggttttaatgtaaatgattttaaatttgggggaaaaaaaagattttaagtgtaagagaggtgttataataattaatttttaaaattttgttattattttattttatttaatggagaagttatgtagttgaaagaatattttaatttttgtttagattagtggtttttaattttttggaagttaaggtttttattaagaattttagaaaggttttaagtttgtttttttttttttttaagtttgtttaaaaaaaaaaaaattaggttgagtagagtggtttatatttgtaattttagtatttggggttaaggcgggaggattatttgagtttaggagttggagattagtttgggtaatatgataagatttcgtttttatattaaagaaaaaagtcgggtatggtggtatatgtttgtagttttagttatttaggaggttaaggtgggaggatggattgagtttaggacgttaacgttgtagtgagttacgatttcgttatagtattttagtttgggagatagaaagagattttgttttaaaaataaaataatggtcggtgtagtggtttacgtttataattttaatattttgggaagtggaggcggggaaattatttgagtttaggagtttaagaatagtttgggtaatatggtgaaatttagtttttattaaaaatataaaataaaataaaatagcgggtgtggtgggtatatttgtggttttaattattcgggagattgaggtgggagtatcgtttgagttggggaggcggaaggtgtagtgagtcgagatagcgttattgtatttagttgggtgatagagtgagattttattttaaaaaaaataaaataatataaaaattaaagtttttaattttaggagttataggaatttttaattaaggtttgttttagattttattattatatttatatttatattatgttagtagtttgaaattataatgtataagtagatatttattttttttttttggaggaatagattgtaatttattttattgtttttaagagaaattaaattagatttattgttaaaattttgttgtattatttatttgattttgaataagtattttaaatttttataggttttaatatttatagggttgttggaagcgtaaaataagataatttatgtttagttacgataagagatataattatgttattattataattatggttattcgtgagttttcgggttttttttgtttttgtttttgtttttttggagtttttttttgtcgtttaggttggagtgtagtagcgcgatttcggtttattggaattttcgtttttcgggtttaagcgatttttttgttttagtttttcgggtagttgggattataggtatgcgttattacgttcggttaattttttttgtatttttagtagagacgaggtattaatatgttagttaggttggttacgaatttttgattttaggtaattcgtttttttcggttttttaaagtggtgggattataggcgtgagttattgcgtttcgttaatatttttttaatattaataataaaaagtgatttgtagttaatatttagtgttatgtgttaagtaatattttaaatgtttaaaatggattattttattaaattttattaatgttataattttatttatggatgaaaagtgtaattggttttaaatatttagtttataaacgatagtgttgtgattatttaagttaaagtaaattgatttaagattttgcgtatatttatttttaatagtttttttcgttattttttagatttaattattaaagttttattgaatttaaaatagattatattatttatatgtaaagaggaaaaatatttttaaaatatttgtggaaaaggttaaaaattgtaagttatattaacgatttgtaagaattttagaattttttttttttaagtaaaggtagttattaaagtgtttcgggcggggaggggggcgagggaggtgagtatgaggagcggagtggagttggatttttataaagggatagcgataaatattttatatttaaaataaggggatttttagtgttatttgcgtcgtcgggttattgtaaatgttcgcgttgagatgtttattttgttattcgacgtagtcgttaaagtttattcggagttgcgttagtttttattgggtttttttaggttaaggaggtacgattttcgtcgtagtatataaagtatatgtttaggagatgggaagaaattcgtcgatatagtattcgggtgtttaagttttcgagaattaggtcgcgcgggtattacggggtgcgcgatcggttagaaagttcgggttaggggtgtttaggagcgagtatcgtcgggaataagcgtcgggaataagtcgggagaaagaggaagcgtcggcgttaaaggtttttcgtttatcgttgtttttttaggattttttatgcgtttgtaaggttacgtcgtttataggattgcgttagcggtcggcgttttaatagagcgcgttagggagtagcgtcgtcgggagttatgacgtttgagtagcgcgagtcgtcgttcggttaggtcgaggtcgtcggttttttcgagatttatttatttgtcgaggcgacggggtggagttttgtatcgaggcgatgtatcgttttacgttagttttgttgcgttttatcgcgtcgttaatttggttttcgaggcgcgtgagattagcgtttaggttcgtagtagtcgttatttttaagaggaaagcgtttgtaaattagtgacgtagcgtcgtagtcggcggaggattattgtgacgaatttgcggcgtagtcggcggaggattattgtgacgaatttgcgtattgcgttagtagtgtgcgttacgttggcgacgtcggcgttcgagttgtattcggttaggtttttggtagcgtcgcgtgttttgagggtgttttggtaagtcgggattagatttcggtcgttagtgtttatagtttagggcgtagatttttagtagataataatttgcgtgatgggtttttaagcgttttggttatttgttttaaattataagtgcgtaatgtattggaagaaaaaaagtatttaggttaatttggtgaacgtgtaaattggaataaagtttttggagatgattggttaaatacgttgtatcggatatgtgtgaatattaaagtatatatttttaaatttatattttattaaatgagggttaggcgtggtggtttacgtttgtaattttagtattttgagaggttacggcgggcggattatgaggttaggaaatcgagattattttggttagtatagggaaattttatttttattaaaaatataaaaaattagtcggtcgtggtgtcggacgtttgtagttttagttatttcggaggttaaggtaggagaatcgtttgaattcgggaggcggaggttgtagtgagtcgagattgcgtcgtttgggcgatagagggagatttcgtttgaatttaaaaaaaaaaaaaaagggagatttagaattgtataatgaaaaagattataaatattaagttttggataattataattttttaaatagttatttcggcgggggattggttttagaattatcgttttatgttaaaatttacgtatttcgtcgggcgttgtggtttacgtttgtaattttagtattttgggaggtcgaggcgggcggattatttgaggttaggagttcgaaattagtttggttaatatggcgaaagtttatttttattaaaaatataaaaaattatttgggcgtggaggtgggtttttataattttagttattcgggaggttgaggtacgagaatcgtttgaaattgagaggcgagggttatagtgagttgagatcgcgttattgtatttaagtttgggcgagagtaagattttttaaaaaaaaaaagaagaagaagaagttcgcgtatttttaaatttcgtagttagttttgcgggtggaatatttagaggaaaagttagatttttttatatgtaggtttttttaatattgtattttttgtcggtttataagcgggtttaggtagtttaaatttatgttatttaagggttaattgtgtatataggaatagttattcgtttggtatagtggtttaagttggtagttttagtattttgggaggtcgaggcgggaggatttttcgagtttaggagttttaggttataatgaattgtgatagcgttattgtattttattttgggtattagagtgagatttttgttttaaaaaaaaaaaaaaaaaggaaaaggaatagtttttttaaatttatatatattttattagtagaataatagaatatattaaaatttaatagtaataatgtaaagattttgagtcgtttgtattttttaaatttttaaaaatgtttattttgggaatttggatattaaaattttatttttaaaataaaatttaataaaatatttttaatagtgagaattttttagattttaaaagtttatatttgtgtaaatattatagtttgaattatgtggataaatattaaatgcgttgatatttttaattggaaatttgggttattttggttgtggataattttttattttttttgtttttttatattttttaaattttgatataatgaataagtattgtttttttaaaaaaggaaaaatagtattttgttttattttaataatattggatgtgaataaaagaaaagaaaaagatgattttgagtttattagtgtgtgtgatttatattaatagaaatgatatgtaaagaaaatttagtttggagtggaaaattttattttaggtagttgattttttttatttgaggtattatttatatatttatgtggggatagtttagtaggaagatgaaatggtaggatagagattttgatggaagttagtagttgcggtatagttttgaggtttagttattttaaaggtagagggggaaatatttttttagtttaggattggagattgtaatgagttatgtttatgtttttgtattttagtttgtggaagagaatgagatttttatttttaaaacgaaaagagggttaggtacgatggtttacgtttgtaattttagtatattgggaggtttagatgggttgattgtttgaggttaggagtttaaggttagtttggttaacgtgttgaaattttatttttattaaaaatgtaaaaattaattgggtatggtggtgtatgtttgtaattttagtttttttggatggttgaggtatttgaattgtttgaatttgggaggtggaggttgtagtgagttgagatcgtgttagtgtattttagtttgggtaatagagtagattttgttttaaaataataataataataatatttaattaatttaaaaataaaaattaaaagagaagatttgatggatttaaaagttatatattttaggtgataggtgaaattataagtttgttttgaaaagtgtgttgataataatagttatagttaataagtatttgttgtgttttaaagttttttttgttagtattttatttgtattaatattatttttttattaattttgtaagggtattgttattatttttagtttttatagataaggaaagtaaaagatagttaggtattatggtttatgtttgtaatttaaaattttgggaggttgaggtgggaggattatttgagtttagtagtttaagatttgtttgggtaatatagtaatattttgtgtttataaaaaaaaagaaattaaaaattagttaggtatggtggtgtttgttagtagttttagttatttgggagattgaagtaggaggattttttgaggttaggtgttggaggttgtagtgagttatgtttattttattgtattttagtttaggtgatagagaaagattttgtttttaaaaaaaaaaaaaaaaaaaggaaattaagagaatgagtattgaagtaatttgtttaaatatatttatttagtaaaaatggtattattaatttatttatgttgaatatatcgaaaaggagtgtttaaagagagaatttttttttttttttttttttttttttttttttttgagacggagttttattttgtggtttaggttggattgtagtggtataatttcggtttattgtaatttttgttttttaggtttaagtaatttttgtgttttagttttttgagtagttgggattataggtatatgttattatattcgggttattgttgtatttttagtagagacggggttttatcgtgttggataggttggttttgaatttttggtttttagtgatttatttgtttcggttttttaaagtgttcggatataggtgttcggtatttatcgcgtttagtatttaaagagagaatttttttgaggaatttaaaagattttttttttttggataagtagtttatatttttgtatttattagggatttttatattttattttattttatattatattttttttttgtttagtggtataatatttttattaaggtattgaaaattttatttgtattagtgtttaatgttatatattttttattatgttgtaaatatagtttatttgtttagttttattgaggtataatttataaataaaaattgtatatatttattaggtataatatgatgttttgttgtttaagtatattttattttatcgtattatattttattgtattttatagatattatgttttttataaattgaaagtttatgtttattttgtgttaaataaatttttttgtattattttttttttttgagatagagttttatattgttatttaggttggagtatagtggtaagattttagtttattgtaattttttgtggtaggttaggttttattaatgtagatttttataataattgttttagtaattattgaatgaagttaaatattaaaagttagtgtttttatataaaggttgggatgtaataaaaggttattaaaatttttgtttaggtttgttttgggttttaaagtatgataaaataatgaaggaatttttttttttttttgagatggagtttttttttgttatttaggttagagtgtagtagtaggattttggttcgttgtaatttttgttttttaggtttaagtgatttttttgttttagttttttgagtagttgggattataggtatgtatgattacgttcggttaatttttgtatttttagtagagatgggtttttattatgttggttaggttggtttcgattttttgatttcgtgatttatttattttagttttttaaagtgtttggattataggtatgagttatcgtatttagtttataacgaaggagtttttaataggatttatttaggattaaattagttttattgcgggtttgaagaaattttttaggtttttatagataagtttattgggggtttgaaagaattttttaaatttttgtgatttagcgggaggtaagataagggtaattatttcggtatcgagggggagtttgtagtgagttgagattgcgttattgaattttagtttgggggatagagtgagatttcgttttaaaaaaaaaaaaattattttaatatttagattaattagattaagtaaatttattgaggttttagagggaggtttttaggatttagattttagttatatattaaaagaagttaattatttacgtttttagatgaatgtatatttatacgtagatatataatttagaaggtagataagttttggaaaattttgtaattttgagttggtttggcgataatttttaggtttttt

SEQ ID NO: 123 - DNA, 6478 bp, Artificial Sequence
  chemically treated genomic DNA (Homo sapiens)
tttattttgaagggatgtttaagaaatattgttaaatttaaaagtgttgtagagtaatatgtattataagattatattggtataatagtaataaatagtatttttttatataattttaaaaaaatatatagatttatgttaagtattagttaagatgtttggtatatggtaggtatttaatatttaatgaatatatgtagaggatttttattttttattttatattttttggataagattttgaatttttatgagtatgtattatttaaatttagatttatagggagtgatggaaaatgtgaaaataaaattttaaaaaggaaaagaaagagtaaagatttagatttaaaaaaggaaatgtaaataagatgaaatagttaaagataggtttttttaaaattaatgttgagataatgttattagtagtgatagttagttaagagatggttcgtagtttattgtttagtattgaggtatttagtaggggttgtatttaatttttaagttggaattaatcgaaattgttgggtttgaagagttgtttttatgagttatcgacggtagaaagtatagaagtattaaagaaaataatttagaaatgtggaaagagaaaagtatgtttttgttttgggagaataatatttgtgtgtaattaagtaggaagattttgtggaggaaagtttgaaaaagtagagagttgaagagaaaagagttaaatgaaggatacggtggttaatatttaaagtaaaaagatatttttgaagaagatgtgtttttagggtttttaagaagtcgttatatttatgtttagagttattttgtaagtttatttggaaagtgtattggtgttttttggtataagatttacgaatattaatagttttgttatgtgagtaggtgtttatattgaagggttataagtaaagtttttatgtgttattattgttagaatttttttcgtttttttttaatataaaagtagttttgtttgttagtatggaagttttgggaagagttttatatttgtttcgtgttgttaatatttttgttttggtttttttgttggaatatataagttatttagtattagttatttatttttttggtagaattgtggtaagaggggattaatagggaaaaaaaattaaaaaataaataaaaagttaaaataatatgaaagagttgggtatgtttttaaaataattagtgtttattttttttagttttgtgtttgtgtttgtttgtattttgtatgtttgtttttgtggtggggggggatatgtttgcgtttttgaaaatttttttatttagatattataaggtattagtttaattttgaatatagtcggttgtagtacggtgtatagatacgattgttttttttttagaaaattttttagtttaaatatgtttgtagagtatgatttatggtgtttttttttggattgtttagtgggtaattgttgtacgaaaattagagaaatagatgtagattttgaattttggttataaatttttgttttatgattatgggttttaaatgtgttgtgttatattgataaatatatagttattttgaaataaaatggattttatttttaaagttttgttttttgttttttattttttgtttgtttgttggttggaaatatatttattagattattgattaaatataaagaaaatagagatgatatatattagaatgttattttatgttataataagaagatatttgggaaagttttttttaattttgtggttaatgtttaaaatgggtgttagtagtttatattttattacggataaatcggtttattttttattttttattttatttattaatttttatagtgtacggatttgtatttaaagaattatggtttatttatgtattttttttttattttatttaaaatgaagaatttggagatagaattaagtttttaagaagtgtaagtatttattgatgaagaaataattagtatgtggttaaattatgggtttgttttataaattaatatttggattaagtaatagttttaattattgttattagtataattaatttatgatgaggaatgattaattgattagcgaatattgttatattataagaaatttatattattttttttatggggatttaaatattgattatttattttaaggtttaagtttattttttagttgagaattttaaggtaattatatattttatatttttttgtataaagaaagaaaatatcgagtcgtttaatttttattatatatagagagagatatattaatgttgttatttttgtgtaatgatatagtatagaggtaagaaattcggaagtagtggtttcgtttaatgaggttgattttatagtttaagaaatgagaatgaatagaattttgaggatatttatttttatttttatttttttgggattagtgtatttttattttttggagagatgttaagtaagaatgtgtagtagttttttttggataatagatttttgtatatatatatttgttagtgatgttatgttttttatttttaatttaagttttttttgttttatttttaatatagttgttttttttttttttgtttaataattttttatttatttttattgttcggtaaaaatgaatttagtttttaaggaattttaaggattttaaataagtatttggagttataagttttatggattaagtagaaattggtatataatgtagtgttttgtgtatttttataattattttaatgatagtgtgttaaatgttttgtaaatttttttgtgtttttttgtttaaaatgtgtgttttttttgtagttaaagggttttttataataagtttttgttataaaatgatggttatataaaagagagaagagaggcgtaaaaataataaatatagatttagtaaaaattttatttttttattgttttgaattttttaatagtaagaattgagtttgttgggttgaaaattgttttaatgtatttttataaaaggatttttgatttggtaagtgtgtgcgatgtatattttttatgttatattataagtgttatttagtaattttattagatagggtagtgttttagtatggggtggggtgttttttgataggtttttaaaaggttcggatgttaatgtatattttaatattatttataaaaaggagattggagtagtgtttttttttgtattgggtaaggagattttttttttttgtttaattatttgtttgttttgttttgtgggagaattataagtaaatgttatagaggtagtggagaaaaaagggtgttttaatttttttttagagttttttttatttgatgtatgttgtattttttaaataagttgtgtaaaatggttgtagggtagattggtttttttttttaaagttttttattcggttgggtttatttgtaaatattgtatttattttttttagtgttttaggattggttggaaagatttttttttttgtaggttgggttagtgtgagagatttaaaaaattatttttttttaaaattattgtattttaataaaaggattgggtaggggttggaatgagagaaaattggttttttaaaatgtaaaattgttatatttaaattagtttataaaatatgcgtttaattatgtggtgggatgtgtgtaggtgtatgatgagagaggtaattaatatggttatttggggtgtaaggatgtgggaataggtaagtaatttttatattggatttttattttagggagttgggttttagttatagttttgagttgtgtgattttgggtaggttttattttttcggggttttgttttattagttgaatagtatgaggatgagttatagttaatatttgttttatgatatttatttagtattatataagtgttatttttgtttttttagttaatattgacgtgggtagtattatatgtttattttatagatgaggaaattgaagtttgaagaagttaaatatttattttagaatatatagttggtaagtggtagatttggaattggaatttagtttagtttgattttttaatttatgtttttgattattatattgtttttttaagtttagatttgaaattttattttttgtgtggttgtgtgtttgggataggggtaattaatttttgattattttatatgttgtatagaatttggagaggattttttaaagtaaatgaatttcgaaagttggattgtagagtaaacgagtgtagttaatttagttaggggtttgtaagagggagaaagagaaaaagattgtggaatggaaagttttttaatttaagttttttttaaggggtagttattttttgttttatagtttagggtttgtatgtgttttttttggagtggaaaaatatataagttataaggaatttaatagatagaaaggcgtatagaggaatttaaagtgtgggttggggggcgaggcggtgggcgggaggcgagcgggcgtaggcggaatatcgttttttaagttaagtcgtcgtaaataaaaaggcgtaaagggagagaagttggtgtttaacgtgagttaggagtagcgtttcggttttttttttgtttattttaaaagtattttttgtattgtttttaaggtgagaaataggaaagaaaacgtcggtttgtgcgttcgttgtttgtttttttggttgtttgtttttgtagggttgttgggagtttttaagttttgtgagaattttgggagttggtgatgttagattagttgggttatttgaaggttagtagttcgggtagggtttatcgaaagtttattcgtatatattaggtaatttaattttttattttgtgtgatagaagtagtaggaagtgagttgtttagaggtaggagggtttattttttgttaaaggggggattagaatttttttatgcgagttgtttgaggattgggatgtcgagaacgcgagcgattcgagtagggtttgtttgggtatcgtcggggtaggattcggaacgtattcggaaggttttttgtaagtatttatttggaaggagaatttgggatttttttgggaatttttcgtttcggttggattggtcgagtaagtttggaaaatggtaaatgattatttggattaattataggtttttagttggtttgtttgttataatttatgattcggggttgggaaaaagattaatagtttacgtgttaaaaaaggggtagagtttgatggagttgggtggatttttttatgttatttgtttttatatttagaggataagtatttttgtagatatttagtgtaagggagattatgtttgattgtatggatgttttgttagtgagttttgggtaaattttggatttttatattgcgagttcgtttttttgtatgttttaggagaaagtttttaaagtatgttttagtggattgatttaaatcgaatggtagtatcggtatattgtttaatgtaggtttatttttttttttttttttattaagaaaaaaaaaattgttttttttgtatgtaataaagacgttggaaataaattgtattggtagtaagataaaggatttaatgatttaatgttgaaggggtgtgatatgttggtatgtatattgattttttttgttgaaaattttttgttagatgttttttttttaaataatttttttcgtttttatgtttttttttttattaattttatagttttttgaaaatagtttttaaaatatgtataaaaatgtggggggtggggagtagagggtgattataagattttaaaatattttttaagtagggtaatttgatatattttgtagtttttattaaaatgtatgtagagtggaatttaattttgttgttttttggattagttattagttgtataggtttttttattttttgtgtattttaatagtttaaagtaattaaaatatgatattttttttgaaaggaatttagtttaattaaggtggttgttgttttcgaagtttataaattattagtttaagttgtcgtttttaatgttttttttgttaaggaaaggtaatattttttagtattgattttgttgttatttttttaagttattttgttggtttaagaagttgttgttttgttagaaaattattggtaatgaatattttttggattgagttatttattatttttatattttgtagtttagttcggaacgtggatattagttaaaggaaaggaaatataagtggggtagtttaatttaaaaaaaaaatattgattattttgttatttgatgttgatatagtgtcgaggtacgtatttggttaatagtagtttggttgtaggtttgagaaatgattaggagttttagaaaattttattttcgggtggttgtagtgggagtttgtaggatgtttcgtcgttttgatagtgatttagataaatggtttagttatttattaaaatgtttttagtattttatttg

SEQ ID NO: 124 - DNA, 6478 bp, Artificial Sequence
  chemically treated genomic DNA (Homo sapiens)
taaataaagtattaaaaatattttgatagatagttgagttatttatttaaattattgttagggcggcgaagtattttgtaggtttttattatagttattcgaaggtgggattttttgggatttttgattattttttaagtttgtagttaggttattgttgattaggtgcgtatttcggtattgtgttagtattagataataaaatagttaatattttttttttaaattgggttattttatttatatttttttttttttaattgatgtttacgtttcgggttgaattgtaagatatggaaataatggatggtttagtttaaggggtgtttattgttagtagttttttagtaaaatagtaattttttagattaataaagtgatttggaaaggtggtagtagggttaatgttaagaaatattgtttttttttagtaaggaaaatattggaagcggtagtttgaattggtggtttatgaatttcgggagtagtagttattttaattaaattaaattttttttaaggaaaatgttatattttaattattttggattgttggaatatataaggggtggggggatttatataattagtagttaatttaaagaatagtaaagttaaattttattttgtatatattttagtaaaaattgtaaaatgtgttaaattgttttatttgaagaatgttttaaagttttgtggttattttttattttttattttttatatttttatgtatattttaaaaattgtttttaagagattataaggttggtaaggagaggagtatgggggcgggaggggttatttgggaagaaaatatttaataggaaatttttagtaaagggaattaatatgtatgttagtatattatatttttttagtattaaattattaaattttttgttttgttattaatgtagtttatttttaacgtttttattgtatgtaagagagataatttttttttttttggtagaagaagggaaaaaaataaatttatattgagtagtgtgtcgatgttgttattcggtttgggttaatttattgaagtatgttttgagagtttttttttggagtatgtaggaagacggattcgtagtgtagaaatttaggatttgtttaggatttattgatagaatatttatatagttaaatatgattttttttgtattgaatgtttgtaaaagtgtttattttttaggtgtggaggtaaatggtatagaaaagtttatttaattttattaaattttgttttttttttggtacgtaggttgttggttttttttttagtttcgaattatgaattatgatagataagttagttaaaagtttgtaattgatttaaatgattatttattattttttaggtttgttcggttaatttagtcggggcggggggtttttagaaagattttaagttttttttttaagtaaatgtttgtaaaaagtttttcgaatgcgtttcggattttatttcgacggtgtttagataaattttgttcggatcgttcgcgttttcggtattttagtttttaaatagttcgtatgggggaattttggttttttttttggtaaagaatagatttttttgtttttgaatagtttattttttattatttttgttatatagaatgaaagattgaattgtttaatatatgcgagtgaattttcggtgaattttattcgggttgttaatttttaaatgatttaattagtttgatattattaatttttaggatttttatagagtttaaaaatttttagtagttttgtaaaagtagatagttagagaggtaggtagcgagcgtataagtcggcgtttttttttttattttttattttaaaaataatataagaagtgtttttaaaatgagtaggggaggagtcgggacgttgtttttggtttacgttgagtattaatttttttttttttacgtttttttatttgcggcggtttagtttggaaaacggtgtttcgtttgcgttcgttcgtttttcgtttatcgtttcgttttttagtttatattttaaatttttttgtgcgtttttttgtttgttaaattttttataatttatgtatttttttattttagaaaaagtatatgtaagttttaaattgtagaatagagaatggttattttttgggaaaggtttgggttgggaaattttttattttatagttttttttttttttttttttttgtaagtttttggttgaattgattgtattcgtttgttttgtaatttagttttcgagatttatttattttgaaaaattttttttaggttttatgtagtatatagagtagttaggaattggttatttttgttttaaatatatagttatatagaaaatgagattttagatttggatttgaaaaaatagtatagtggttaagagtatgggttggggaattaaattgaattagattttaattttaggtttgttatttattagttgtgtgttttgggataagtatttaatttttttaggttttagtttttttatttgtaaaatgggtatataatattatttacgttagtgttaattgggaggatagaaataatatttgtatggtgttgggtaaatattatggaataaatgttagttgtgatttatttttatattgtttaattggtgaaataaaatttcggggagatgagatttatttaaggttatatagtttagagttgtgattagaatttagttttttaggatgaaagtttaatgtgaaaattatttgtttgtttttatatttttgtattttaaatagttatgttggttgttttttttattatatatttatatatattttattatataattaaacgtatattttgtaaattggtttaagtatgatagttttatattttgaaggattagtttttttttattttagtttttgtttaatttttttattaaaatatagtaattttaagggaaaatgattttttagattttttatattgatttaatttataggaagaagagtttttttagttagttttaaaatattaagaaggatagatgtagtatttataaataaatttagtcggatggagagttttaaaagggagagttaatttattttgtagttattttgtataatttgtttaaaggatgtaatatatattaaataaaggaaattttggagaggaattaaaatatttttttttttttattgtttttgtagtatttatttgtaatttttttataaaatagggtaggtaagtggttaggtagggagggagagtttttttgtttaatgtagggaagagtattgttttagttttttttttgtggatagtgttggaatgtgtattggtattcgggttttttaaaagtttgttagggggtattttattttatgttgaaatattgttttgtttagtggagttgttaagtggtatttgtggtgtaatatgaaaagtatgtatcgtatatatttattaagttaaagatttttttatgaaggtatattaaaataatttttagtttagtaagtttagtttttgttattgaaaagtttagggtaataaaggggtgagatttttgttgaatttgtgtttgttatttttgcgtttttttttttttttttatatggttattattttgtaatagagatttattgtaagaaattttttaattataaagaaaatatatattttaagtaagagaatatagaggaatttataaaatatttaatatattgttattaaggtagttgtaaagatatataaagtattatattatgtgttaatttttatttggtttatgaggtttatggttttaaatgtttatttaaggtttttagagttttttggaaattgagtttatttttatcggatagtggaggtggatgaaaagttgttagataagagaagaggaaatagttatattggaagtagagtaggagaaatttaagttagagatgagaaatatggtattattgataggtatgtgtgtatagggatttgttatttaggggaggttgttgtatatttttgtttaatatttttttaaagagtagagatgtattggttttagggaagtgaagatggggatgggtgtttttaaaattttgtttatttttattttttaagttatggaattagttttattgagcgagattattgttttcgaattttttatttttatattgtattattgtataaaaataataatattagtgtgtttttttttgtgtgtggtaaaggttgggcgattcgatgttttttttttttgtgtaagaaaatgtaaaatatataattattttgaagtttttaattgagaaatgaatttgggttttgaaatgaataattagtatttaaatttttatgaaaggaatagtatgggttttttataatatgataatattcgttagttaattaattattttttattatgaattaattatgttgatagtaataattagagttattatttaatttaagtattaatttataaaatagatttatgatttagttatatgttaattatttttttattagtaaatgtttatattttttgaaaatttgattttgtttttaaattttttattttaagtaaaatgaaggaaagatatataaataagttataattttttaaatatagattcgtgtattataaagattaatgagtagggtagaaagtgaaaaatagatcgatttgttcgtaatgaaatgtaaattattgatatttattttaaatattagttatagggttggaagaaatttttttaaatatttttttgttatggtataaaataatattttgatatgtgttatttttattttttttgtgtttgattaatgatttaataaatgtatttttaattaataagtaaataaaaagtgaaaaataaaaagtaaaattttgagagtaaaatttattttgttttagagtaattgtatatttgttagtgtgatatagtatatttgaaatttataattataaaataaaaatttatagttagggtttagggtttatatttgtttttttggttttcgtatagtaattatttattggataatttagaaagaaatattatgaattatgttttgtaaatatgtttgaattggagagttttttgaagaaagagtagtcgtgtttgtgtatcgtattgtagtcggttgtgtttaaaattgggttaatattttgtgatgtttaaataagaagatttttagaggcgtagatatatttttttttattataggggtagatatgtaaagtgtaggtagatataggtatagggttgggggaggtggatattgattgttttaaagatatgtttagtttttttatgttgttttggttttttgtttgttttttaattttttttttttgttaatttttttttgttatagttttgttagaagaataaatggttagtattgagtgatttgtgtgttttagtagggaagttaaggtagagatgttggtagtacgaggtaagtatgaggttttttttagggtttttatattagtaggtagagttgtttttgtgttggaagggagcgggggaagttttaatagtaataatatatggaaattttgtttgtggttttttagtatgaatatttgtttatataataggattgttgatgttcgtggattttatattaaaagatattaatgtattttttaaatgaatttgtaaggtggttttgggtatgagtatagcgattttttagaaattttagaaatatattttttttaaaaatgtttttttattttgagtgttggttatcgtgttttttatttggtttttttttttttagttttttgtttttttagatttttttttataaagtttttttatttggttatatataaatattgtttttttaagataagggtatatttttttttttttatatttttgaattattttttttagtgtttttgtgttttttgtcgtcgatgatttataaagatagttttttaagtttaatagtttcggttggttttaatttgaaagttaaatataatttttgttgaatgttttagtattgagtagtgagttgcgaattattttttagttgattgttattgttggtggtattgttttaatattagttttggggagatttatttttggttattttattttgtttatatttttttttttaaatttagatttttattttttttttttttttttaaaattttatttttatattttttattattttttataaatttagatttaagtaatatatgtttataaaaatttaaagttttgtttaaaagatataaagtgaaaagtaaaagttttttatatgtatttattaaatgttgaatatttattatgtgttaggtattttaattggtgtttggtatagatttgtatatttttttgggattgtgtgggggggtgttgtttgttgttattatattagtatggttttatgatatatattgttttgtaatatttttaaatttagtaatattttttgaatatttttttaaaataaa

SEQ ID NO: 125 - DNA, 6098 bp, Artificial Sequence
  chemically treated genomic DNA (Homo sapiens)
aaaatttagggtcgggtacggtggtttatatttataattttagtattttgggaggtcgagtcggatagattatgaggttaggcgttcgaggttaggagttcgagattagtttggtcgatatggtaaaattttatttttattaaaaatataaaaattagttaggcgtggtgacgggtatttgtagttttagttatttgggaagttgaggtaggagaatcgtttgaatttaggaggcggaggttgttgtgagttaagatggtgttattgtattttagtttgggcgatagagtgagattttgttttaagaaaaaaaaaaaaattggcggggtatagtggtttatgtttgtaatttagtattttgggtggttaaggtgggtggtttgtttgagtttaggagtttaagattagtttgggtaatatggtgaaattttatttttataaatataaaaattagttgagtatggtgatgttcgtttgtggttttagttattcgagaggttgaggtaggaggatttattgagtttgggagttaaggttgtagtgagttttgattatgttagtgtattttagtttggtaatagagtgagattttgttttaaaaaaaaaaaaaaaaaaaaggaaaaagaaaaaaaaaggtaagtggtaagaagtaaattatttagtttaatgatattttttattttggttttatttgtttatttgttaatgtatttaaatgtataaatataagattataatttgtaggtgggggaaggtattttggtatataattgttaaaaattttagttgttaaaggataaggttgtagggagataggtcggtagttatgatttttatgtttaagtttttgaaatttaaatgtgtgtattaattgagataatttaataattttattagtatttttgtagttagatatttgttaagttttgatattatttgttattattgagaatagagttttgttttttatttagggtgagataggataagggaggagaggtaggttagtttatttagatttaaggatatgtaagaatggaagggttaagagttacggatatgtatgtagtggaaatgtagggtgtgttgtataagtatgatttgtaaagtattgttaaagtcgtttaaggtgttttttaattatttatttattattgattatttagtaattgtttgtttagattagatgttaaagaaagagaaaagtaaatttatttcgtgtttttaataaatatagtttagtaaaggagatattatattaattggagatttggagagattgttaaaatatagattgttgggttttatttttagagttttttattgagttgttttggggtggggtttgagaatttggtttttaataagtttttaggttatggtgatgttgttgttttgggaattatattttgagatgagaattatttatatttaaattaagattatgttttttaataaaggtaagtatagattggattgttgagagagtttagagaaaggagagattaattttgtttgggagaattttggaataattttgaaggatggatagaatttgaataggattttgtttggttatttggagaggaagaaaaagatataaggaatagtttagggggtatgtgaagggtgggggagttagaaatttatgttgtaggaaaggtagtaaggaaggaaaggagtgaaagtttatattattgaataagttaataatggagtttaagaaaagtgaagaattttttaagaaaaagagttgtttaaagttgttgtttaaaataagatttatagattatatggttttattttagattagaatgattatttttgaggttggagatatttttttaataagtatttcgggggttaggcgcggtgttttatatttgtaattttagtattttgggaggtttaggcgggtggattataaggttagtagattaagattattttggttaatatggtaaaattttgtttttattaaaaaatataaaaaattagttgggcgtggtggcgggtgtttgtagttttagttattcgggaggttgaggtaggagaatggtatgaattcgggaggcggagtttgtagtgagtcgagatttcgttattgtattttagtttgggagcgagagggagatttcgttttaaaaaaaataataagtatttcgttgggtatggtggtttacgtttgtaattttagtattttgggaggttaaggtgggtggattatttgaggttaggagttcgagattagtttggttaatatggtgaaattttatttttattaaagatattaaattagttaggcgtggtggtatgcgtttgtagttttagttattcgggaggttgaggtaggagaattgtttgagtttaggaggcggagattgtagtgagttaagattatgttattgtattttagtttgggtaataaagtgagattttattttaaaaataaaagatataagataaaatttagaggatttagttattgatttgatttggagggtaaggtggtttagttttagttatttgggaagttgaaatgggaggatcgtttgaggttaggagtttgaagttatattatatttgttaatagttattgtatttaagttcggtaatatagtaagattttatttttttaaaaaatgaaatatataagaaaaagatattttaaaaattattggaggttaggcgtggtggtttatgtttgtaattttagtattttgggagttcgaggtaagcggattatttgaggttgggagttcgagattagtttggttaatatggcgaaattttatttttataaaaaatataaaaattagtcgggtgtggtggtaggagtttatagttttagttatttaggaggttgaggtaggagaatcgtttgaattcgggaggtggaggttgtagtgagttgagatcgcgttattgtattttagtttgggtgataaaatgagatttcgtttgaaaaaaaaaaaaattgtaatggggtcgggtacggtgttgcgtcgtttgtaattttaatattttgggaggtttaggtaggaggattatttaattttagaagtttttgagattagtttgggtaatatagtgagtttttatttttattaaaaaaaagttttttgattttgtttttgtttttttttttaaattatacgggtatggtggtatatatttgaagttttagttatttaggaggttgaggtggggggattacgagtttaggaggttgaggttatagtgagttatgattgtgttatatattatttagtttgggtgatagagcgagattttgttttaaaaaataaaataaaagttattgtaatgggattttgagggatatagggaaaattgtattattggagagttttaggagagaattgatgaaattttggttgttttatattttgtttaagataaattttataggtttagataagtaaaaattgtgagatagtttattttttttttaaattcggaaagtatataaggtattatgtgaaaatatttttttggtgagtgatgggaaataatttagtttgagagttaattagatttagatttagatttagatttgaattttatttatgttattgattaggattaattttagataagtaatttattttttttgaattgtaatttttttatgtttaaatgggaggagaatgtttaagatgtagagttgtgaggattaaataggttgtcggtttgtataaagtgtttatattttgtttgggagagaatcgttgtttaggatggtgatatggtaaatagtatgggtttaggagttgaattgtttgaggttgagttttagttttattatttaattattatagatttcgggtaaatttttttaagttagttttttcgattttagaatggagataatagtatttattttttagtgttatgatgattaaattagatgatgtgtataaatagattaatttgatttggtatagggtaagtagttgttattttttttttttattttttttatgtttattttagttggtaatgttagtgatattattagattttaattgttgggggtaaatattttttttgtttgtttttttaaaattaaatttagtagtggggggttgtatattaattttagtgattttaacgttgataagttttgataatttattattatcggattagttatttttattgatttttgtttttttttttttagttaatagtgttttcgataggtattaataaatgttttatttttttttttgtgttttttaagagaaaaagtaaattttagattgtgtttttttttttagcgttagagaaaggaattataataaagtttagttgttgagtttagagcgtatagtatagtcgtttttttagttttttcgtcggtcgggaggagttttttttgtttttgtttattgttggagttgttaataaagttttattcgaatatttgagttgtcgcgttttgcgttttttttatgagtttttttcgttcgtaatacgagatttagtattatataattagcgtggtaaagtttgaagggcgggataggaagtgaggttattttttatcggggtgaaaggttagcggaagtgttttttttttttttttgttggtagggtcgggtggttgttgtcggtaagtagaagtttgggttgaattttttaattcgttgttattcgcggtttgggggtcgaaggttcgggcggcgtcgggtgtattttttttttaggtttttggcggttacgtattcgattttgttttgcgagtagggttttcgggcggttttgattaaggcgatagtgaatatagtttgaagtttcggtttaagatttgggtttgttggtaggagttagttttgggtatttttggttttacggatttttaagtggttttttttttttgttttttgtagaaatgggtaagtttatgaaatttgggaaggtggtgtttgttttggttggacgttatttcggacgtaaagttgttatcgtgaaggtattagtttcgcgggattttgcgtttttgtatgtcgggattaggttggttgcggcggggcgggtaggtttggaatttaaggtttgtttttggggtagtagttagtgagtacggttagggtgaacgtgggagagtttttgagagaggaagaagtatagtaaaagtaaatgtgagttgaattgggtttttaacgtataaagttttttttattagaggttttaaatatatagtaatagtggttgatattgtacgtttgttatgtgtttttattgttttttaggtattgttatgtgtagtttttgaagtaattataggggatttttttttttttttttttttttttttttttttgagacgggatttttgtttaggttaagtgtagtggcgtgattattgtagtttcgatttttcgggtttaagcgagttttttattttagtttttcgagtggttgggattataggtgcgtgttattatttttagttatagggggtttttttttgttgttaaggtttggaggtgttttgttatttatttgaagtgttgtagttgggaatttgtaagaagaggaggaaattgtttttagaaaggttatatagttttttattgttttttttttatttatgattttgtagttttttgagagagttttttaggttttggttatatatattattgcgttttgttgttgtggggatattggagtatttttggattttttttttttattttttgagattgatttttggagttaggttgtggtgttttaattttggttgtatattttattagtagtggagtaagtgaatagatattaagttttgtgagtagtgtttggtatatagtaagtattttttaaatgttaattgttgttatttttaaattttttatttttagtaagtcgttttagatgttttttgatggagataaatattgttttgtttttttttggttattttttatagttttttgtgatttttttttttataatggtggattttggagatttgagggtggaaatattttttggatattgtattatttataatatagggtttaaataggtttttagtgaataataaatgtaatttttatttatttaga

SEQ ID NO: 126 - DNA, 6098 bp, Artificial Sequence
  chemically treated genomic DNA (Homo sapiens)
tttaaatgagtaagaattatatttgttatttattgagggtttatttaggttttgtgttataggtagtgtagtgtttaaaaaatatttttatttttaggtttttaagatttattattataaagagaaaaattatagaaagttatgagaaatgattaaagagaaatagaatagtgtttatttttattaggaagtatttggaacggtttattagaggtaagagatttaaaagtagtaatagttaatatttaagaagtatttgttatatgttaagtattgtttataggatttggtatttatttatttgttttattgttagtgaagtgtatagttaaggttaagatattatagtttaattttagagattagttttaggagatgggagaggggaatttaggggtattttagtgtttttataataataaaacgtagtggtgtatgtggttagagtttagggaatttttttaagaagttataaaattatggataagaggaaaatagtgaggggttatgtgatttttttaaaagtaatttttttttttttttatagatttttagttgtagtattttaggtaaataatagaatatttttaaattttagtaataggaaggaattttttatagttggggatggtggtacgtatttgtagttttagttattcgagaggttgagatgggagattcgtttgagttcgggaggtcgaggttgtagtgattacgttattgtatttagtttggatagagatttcgttttaaaaaaaaaaaaaagaaaagaaaagaaaaggaattttttatgattattttaaggattgtatatgataatatttgaaaggtagtgggagtatatagtaagcgtgtaatgttagttattattattatatatttaaagtttttggtggagaaggttttatgcgttgggagtttaatttagtttatatttgtttttattgtgttttttttttttttaaaaatttttttacgtttattttgatcgtgtttattggttattgttttagaaataggttttgaattttaagtttgttcgtttcgtcgtagttagtttggtttcggtatgtaaggacgtagagtttcgcgaggttgatatttttacgatgatagttttgcgttcggagtagcgtttagttaggataagtattatttttttaggttttatgaatttgtttatttttgtagagagtaaggagaaagggttatttaaaaattcgtaaagttaaagatgtttagagttgatttttgttagtaagtttaggttttgggtcggaattttagattgtgtttattgtcgttttggttaaggtcgttcgagggttttgttcgtaggataggatcggatacgtagtcgttagagatttagggaaggaatgtattcggcgtcgttcggattttcgatttttaagtcgcggatggtagcggattgaaagatttaatttaagtttttatttatcggtagtaattattcggttttattagtaaaaaggaaagaaggatattttcgttaattttttatttcggtgaggagtgattttattttttgtttcgttttttaggttttgttacgttgattgtgtggtgttgagtttcgtgttgcgggcggaagaagtttatgagggaaacgtagggcgcggtagtttaagtattcgaatgaaattttattagtagttttagtagtagataagagtaaaggagatttttttcggtcgacggaagagttgggagggcgattgtgttgtgcgttttggatttagtagttaggttttgttgtagtttttttttttggcgttaggagggggaatataatttgaaatttatttttttttttgggagatatagggaaaaaaatagggtatttattggtgtttgtcgggggtattgttagttaaagagggagggataaagattagtaagggtggttggttcgatagtagtgggttattagaatttattaacgttagggttattaaagttggtatataattttttattgttaaatttggttttaaaaaaataaataaaaaggatatttatttttaatagttaaagtttagtggtgttattgatattattaattagaataagtatgagggaggtagaggagaagaatggtagttgtttattttgtgttaggttaggttaatttatttatgtatattatttgatttggttattataatattaagaaatagatattattatttttattttagagtcgaggaaattggtttagagagatttgttcgaagtttatagtggttaaatagtggagttggggtttagttttaagtagtttaatttttgaatttatattgtttattatgttattattttgagtagcgatttttttttaggtaagatgtgagtattttatataagtcggtagtttgtttaatttttataattttgtattttgggtattttttttttatttagatatgaggaaattgtaatttagagaggataaattgtttgtttgaggttaattttaattagtggtatagatgggatttaaatttaggtttgaatttaggtttagttggtttttaaattgaattattttttattatttattagaagagtgtttttatatggtattttatgtgtttttcgagtttaagggaaagataaattattttatagtttttgtttatttgaatttataggatttgttttgggtaagatgtggaataattaggattttattagtttttttttgaagttttttagtgatataattttttttgtattttttaggattttattgtaatggtttttgttttgttttttgagatagggtttcgttttgttatttaggttgaatggtgtgtagtataattatggtttattgtagttttaattttttgggttcgtgatttttttattttagttttttgagtagttaggattttaggtatgtgttattatgttcgtgtaatttgaagaaaaaaataaaaataaaattaaagaatttttttttggtagagatggggatttattatattgtttaggttggttttaaaaatttttgggattaagtgatttttttatttgagttttttaaagtgttgggattataggcgacgtagtatcgtgttcggttttattataattttttttttttttagacggagttttattttgttatttaggttggagtgtagtggcgcgattttagtttattgtaatttttatttttcgggtttaagcgatttttttgttttagttttttaagtagttgggattataggtttttgttattatattcggttaatttttatattttttgtagagatggagtttcgttatgttggttaggttggtttcgaatttttagttttaagtgattcgtttgtttcgaatttttaaagtgttgggattataggtatgagttattacgtttggtttttaatggtttttaaaatgttttttttttatatattttattttttaaagagatgaggttttgttatgttgtcgggtttgaatgtagtggttattgataggtgtgatgtagttttaaatttttagttttaagcgatttttttattttagttttttaagtagttaggattaagttattttattttttaaattaaattagtaattaaattttttgaattttgttttatgttttttatttttgagatggagttttattttgttgtttaggttggagtgtagtggtatgattttggtttattgtaattttcgttttttgagtttaagtagtttttttgttttagtttttcgagtaattgggattataggcgtatgttattacgtttggttaatttagtatttttagtagagatggggttttattatgttggttaggttggtttcgaatttttgattttaggtgatttatttattttggttttttaaagtgttgggattataagcgtgagttattatgtttagcgggatgtttgttattttttttgagacggagtttttttttcgtttttaggttggagtgtagtggcgagatttcggtttattgtaagtttcgtttttcgggtttatgttatttttttgttttagtttttcgagtagttgggattataggtattcgttattacgtttagttaattttttgtattttttagtagagatagggttttattatgttagttaggatggttttgatttgttgattttgtgatttattcgtttaggttttttaaagtgttgggattataggtgtgaggtatcgcgtttggttttcgggatgtttattaaagaagtatttttaattttagagatagttattttggtttggagtggagttatatgatttatagattttattttgagtaatagttttaaataatttttttttttgaaaagttttttattttttttgaattttattgttggtttatttaatagtatgaatttttatttttttttttttttattattttttttgtagtataaatttttgatttttttattttttatatattttttgggttgttttttgtgtttttttttttttttttaagtaattaggtaaaattttatttaaattttatttattttttaaggttattttagaatttttttaggtagaattaattttttttttttttgggtttttttagtaatttagtttgtatttatttttattagagaatataattttagtttggatatgagtggtttttattttaaagtgtggtttttagagtagtagtattattataatttaggaatttgttagaaattaaatttttaggttttattttaaaataatttaataaaaaattttggggatgggatttagtaatttatattttaatagtttttttaaatttttaattggtatggtattttttttgttagattgtgtttgttgagggtacggggtaggtttatttttttttttttttagtatttagtttaggtaggtagttgttaagtgattaatagtgaatgaatgattggagagtattttagacggttttaataatattttgtagattatatttgtataatatattttatatttttattgtatatatattcgtggtttttgatttttttatttttgtatatttttggatttgggtggattggtttgtttttttttttttgttttgttttattttaagtgaaggatagagttttgtttttagtaatgatagatgatattagagtttagtagatatttgattgtagggatgttgatggaattgttgggttgttttagttgatatatatatttaggttttaagaatttagatatgaaagttatggttgtcggtttgtttttttgtagttttgttttttggtagttgaaatttttggtagttgtgtattaaaatatttttttttatttataagttgtaattttgtatttatatatttgaatatattgataggtgaataggtaggattagagtagggaatattattgaattgaatgatttattttttattatttatttttttttttttttttttttttttttttttttttttttgagatagagttttattttgttgttaggttagagtgtattggtatgattaggatttattgtagttttgatttttaggtttagtagatttttttattttagtttttcgagtaattgggattataggcgagtattattatgtttagttagtttttgtatttgtagagatgaggttttattatattgtttaggttggttttgaatttttgggtttaagtaagttatttattttggttatttaaagtgttggattataggtatgaattattgtatttcgttaattttttttttttttttgagatagagttttattttgtcgtttaggttggaatgtagtggtattattttggtttatagtaattttcgttttttgggtttaagcgatttttttgttttagttttttaagtagttgggattataggtgttcgttattacgtttggttaatttttgtatttttagtagagatggggttttgttatgtcggttaggttggtttcgaatttttggtttcgaacgtttgattttataatttgttcgattcggttttttaaagtgttgggattataggtgtgagttatcgtgttcggttttaaatttt

SEQ ID NO: 127 - DNA, 6282 bp, Artificial Sequence
  chemically treated genomic DNA (Homo sapiens)
tatagtgggaattttgtgtggggttttaattttatattttttttttgtattgatttagtagaggttttttatgagggttttgtttttatagtataattttgtttggatatttaggtatttttatatattttttgaaatttaggtggaggtttttaattttaatttttgattattgtgtaattataggtttaatattacgtggaagttgttaaggtttggtgtttgtattttttgaagttatagtttaagttgtattttggttttttttagttattggagtagttgggatgtagtgtattaagtttttaggttgtatattgtagggaggttttgggtttagtttataaaattatttttttttgttaggtttttaggattgtaatgggaggggttgttttgaaggtttttgatatgttttggagatattttttttattgttttggtgattaatatttgttttttttttatttatgtaaatttttgtagttagtttgaatttttttttagaaaatgggtattttttttattgtattattaggttgtaaattttttaaatttttatgttgttgttttttttgaatattttgttgtttaaaaatttttttttttagataatttaaattattttaaatttaaagttttatagatttttagggtaggggtaaaatgttaatattttttttgtatagtaagagtgacgtttattttggtttttaataagttttttatttttatttagattattttagtttggattttattgtttatattattattaatattttcgttaaagttatttagtaagtttttaggaagttttaaatttgtttatatttttttgttttttgagttttttaagtttttaggaagttttaaatttttttatttttttttatttttttttgagttttttaaattgtttaatggggtaggagaatagggtttggaggtagggaatataaggttgatttatgttgattttttagaattaaattaaatggaagtattttagtaatgatagaaatgtgaatggttttgtaattttattttattttttttatttatattatttatattttgtaatttaatatttattttttttattttcgtagtttatatattttaagtaatattttttttatttatattttgtaattttatatttatttttagtatttatatagattatatacgttaagtaatattatttttatttatataggatgtattttgagtaaatgattgtaattttattttatttttatttatatagaggtatattaagtaattaaagagaaatttttagagtattgaaattttagaaaattttgtaatggggatttttgagttttgatgtttaggtttgtttttaatattgtggagtgtatttttgtttttaataaatttttgtttttgttttttttgttttgtttgtgtattttgtttaattttttgtttaagacgttaagaatttggatattttttattagtaatttttgtttgttatttagttttaaagtcgtttttatatttttaggtatttttatagtagttttttattttaggtattaatttattgtattagtttgtttttataatgttaataaagatatattcgagacgggataatttataaaggaaagaggttattgatttatagttttatatggttgtttataatttataattatggcggaaggtaaaggaggagtaaagttaggttttatatagtagtaggtaagaagagtgtgcgtagaggaatttttttttataaaattattagatgttgtgagatttatttattattaagagaatagtatggggaaaattgtttttatgattggattatttttatttggttttgtttttgatatttggggtttattataatttataatgagatttaggtggggatatagttaaattatattattaggtaattttttttaatgattgaggtagttttttattttaggtttttcgtattatcgattttgttgtcgagaataaggaggagtttagtaaggggatcgaatttgtttgtaatattgggaaattttgtagtggttaagataattagttaggaggggttttagttttggggggaattttattttagaaaattagttttgattatttataaagttttaaagaggtaaagaatggtgtaagtttagtagaaagttagttaggttttgggtatggagttttcgagttgttttttttggtgatatgtttttttaggttataaggttgaatgatacgtaaacgtttatgtttttaaagatttaagtatttttcgttttgttggttttttcggtatttttgtgaagtgagtagaaggttaggtttgttcgttttttttttttttttagatgataaaattgatggtttttttttcgttttttaggagcgtatagatataggtaggtttgtagtaggtgaaatttatttaagttagagtgtagtggtgttattatagtttattgaagtttttaatttttggtttaagtaatttttttgtttttgttttttaagtaattgggattgtaaagtgagtgttattaaatttagttattttttttttttaatatataaatgaggttttggtttgttttttaggttgtttttgaatgtttggttttaagtaatttttttgtttttgttttttaagtaattgggattgtaaagtgagtgttattaaatttagttattttttttttaatatataaatgaggttttggtttgttttttaggttgtttttgaatgtttggttttaagtaatttttttgttttggttttttagagtgttgggattataggtgtgagttattatatttagtttagttttagatttttagagaaattttaatagtattttatattatagtgatttttttttttaaaaaaaatttatgtttttagtatgtatagtaaatattaaagtgatttttaaagaattttttttttttattatttttagtaggtttttgtgaaattaaatttattttcgtttataagaaagatgttgggttggtttttttttaaagtttttttaaattttttttggtattgatttagatattttaggaatttaatttgagaaaatgtttttattaaaaaaaattttaggaagtaaaattttttgaatgattattgagttgatataaattttatgtgtatatttttattagaaaaaaagtatttttattttgtgggatattaatttatgtattattattattttgagataaagtttcgtttttgttgtttaggttggagtgtaatggcgcgatttttatttattgtaatttttattttttgagtttaagtgattttcgtgttttagtttttttagtagttggaattataggtatgtgttattatatttagttaattttttgtaattttagtagagatggggttttattatgttggttaggatggattcgaatttttgattataggtgatttgtttattttagttttttaaagtgttgggattataggtatgagttatcgcgtttagtcgttgggttttatagtaattttatgtttaatattttgaggaaatgttatttttttttaaagtgattgtattattttatatttgtattagtattgtacggatatttttatttttttgttttagtgagtgtgaaatggtattttattgtagttttagtttgtatttttttgatggttaatgatgtggattattttatgtgtttattggttatagagaaatgtttatttggattttttatttattttttaattgggttatttgtttttataggtttgttgttgttgagatagagttttgttttgttatttaggttggagtgtagtggtattattatagttaattgtagtttagaattgttgggtttacgtgattattttagtttagtttttcgagtaattgggattataggtatgcgttattagttttagttaattattttattttttgtagagatagggttttattatgttgtttaggtcggttttgaatttttgggtttaagtaaattttttattttagatttttaaagtattggaattataggtgtgaattatagtgtttagttaatttgtataataattttaaatataaaagttaagtaaaataaattaagagtatttttaaaaattaggtagtttgggaggtaggggttgtcgtgagtcgtgagatggtatttttgtattttagtttaggtgatagagggaggttttgtttaaaaaaaattaaaaattaaaaaataaaataaaataaaaaatatttaggtagtagttcgtgttcgtaattttagttatttaggaggttgaggcgagagaatcgtttgagtttaggagtttaagattagtttgggtaatagagtgagattttatttttaaaaaatgaataaagaaaaattaggtagtttcgtttagtggttagaagcgtggagtttggagttaagtttttaaattttattttttatatatgtaaaatggagataataataggggtacgttatagaattgtggtaggtatagtgaattttatcgtatgttagttgttttcgttattatttattgtttaaattcggtgatgaaattattaggaagtttttgttttgtttttttttgattattaagaggcgtatttcggagtagaagaaacgcgggcggaaatagtttaaaagcggattggtttcgatttttggcggaagtaaatttttttttttattaggttttattagtttagaaagaattttaaatttttacgtagttttaaggataggtagaatatattttttagttttatttttagttattattgtttattaaaatatgtatatttagaatttttgcggtattattttttgacgtgtttttattttatttaaaagagtcggagtcggaagtgtttgtttttttttttgttaggatttaggggttacgatttattagtttttgcgcgttatcgttttttttttttttttcggcgttgtttacggaggtggtagttatttttttttcggtaagtgttaattcgtggtaattcgtatttttgcgggatttatttggtttcgtcgtttagtggtgcggaggttttttttttagcgcggtagtgtttgtgggtattgttattgttagtttattggagcgtgtataggaatagaacgaagtcgtcgagttgatagggttttgcgttttagagttttttgtttttcgtttgtatttagagttgcgggttgtttgtttgttttttggcggtggagggtgttagttgaggttagatttcggggttttttgggggtcgtgggacgattaggggtggtttagtttgatagtttttagttgggatttgtggattttagcgtttattaatgtcggtttacgtgtattcgtttatgttatggtcggtttttttcgttgtagtttttggttcgagggttgttgttgcgggatcgttaaggaaagacgagttgtaggtcggttggtttagttgtaggtagaaattttggtagtatttttgggaatatgaagatgtaattgtttttattttgttttcgaggatattatgggttagaaggtagagtcgttttgaatacgtggtttattgagtatttattttgggttagttgatggttgcgaagagagtagaaggggtgttgttgtaggaaattaatggttcggaagattatattgaggaaggtgtgagttgatattggaagatttttaggtttgaggtatttttagaggtatatggtggttttgtgtgtgttgagggtgtggtagcgtagtagttttttagggaattagaaggttttattgaatatttattttgtgataggtattgtaggtatttagcgcgtagtgttatttttattttataggtgaggaaaagatttaggtttaagtagatggttaaggttagtattatcggaaggattatttgggggttcggatattggtggggtgggatttgttgttttttgtaaattgagagtgttttggggttagttttgatttgtttagttgttggtattttttgggttttgagtgggtgaggtgatttttgattttttgggatcgtatttggagagtgtttagtattttgttagtttcggaaagggagggaaagtaagtttggtagaggtatttattttatttttagtttgtttcgtagttggcgattggaagatattttgcgatagtgtttagtttttgggtaggaaagtttttttttaggatttttttttatttggggtcgttttttttttaaaagg

SEQ ID NO: 128 - DNA, 6282 bp, Artificial Sequence
  chemically treated genomic DNA (Homo sapiens)
ttttttggggaagaagcggttttaggtgaggaagaattttggaaggaggtttttttgtttagggattgaatattgtcgtagagtgttttttaatcgttagttacggagtaagttgggaatggaatgggtgtttttgttaggtttgtttttttttttttttcgaagttggtagaatattaggtattttttagatgcgattttaggaggttaagggttattttatttatttagagtttaaagaatgttaatagttgagtaaattaaaattgattttaagatatttttaatttgtaaggggtagtaaattttattttattagtgttcgaatttttagatggttttttcggtagtattggttttgattatttatttgaatttgagttttttttttatttgtaaaatgaagatgatattgcgcgttgaatgtttgtagtgtttgttatagggtaaatgtttaataaaattttttaattttttagggagttgttgcgttattatatttttaatatatataaaattattatatatttttgaagatgttttaaatttggagattttttagtattaatttatattttttttagtgtggtttttcgagttattgattttttatagtagtattttttttgtttttttcgtagttattaattggtttagagtgggtatttaatgaattacgtatttaaaacgattttgttttttggtttatgatattttcgaaggtaaggtgggggtagttgtatttttatatttttagagatattattagaatttttgtttgtagttggattagtcgatttatagttcgtttttttttggcggtttcgtagtagtagttttcgggttagagattgtagcggaagaagtcggttatggtatgaacgaatatacgtgggtcgatattggtgagcgttgggatttatagattttagttgaaagttgttaagttgggttatttttggtcgttttacggtttttaggagatttcgaagtttggttttaattagtattttttatcgttaaggaataaataagtagttcgtagttttgaatataggcggagggtaggaggttttgggacgtaaagttttattaattcggcggtttcgttttgtttttgtatacgttttagtaagttgataataataatatttatagatattatcgcgttgaaggggaggttttcgtattattgggcgacggggttagatgaatttcgtaggaatgcggattgttacggattaatatttatcgagaaggagatggttgttattttcgtaggtagcgtcgaggaagagagaagggacggtggcgcgtaagggttgatgggtcgtaatttttgggttttagtagggaaaaaggtaagtattttcggtttcggtttttttaaataaaataaagatacgttaaaaaataatgtcgtaaaaattttgagtatatatgttttaatagataataataattaggaataggattgagaaatgtattttatttatttttgggattacgtagaaatttggaattttttttgagttaataagatttggtggagggaggaatttattttcgttagaagtcgaagttaattcgtttttgggttattttcgttcgcgttttttttatttcgaagtgcgttttttagtggttagaagagaataagatagagattttttaataattttattatcgaatttagatagtaaatagtaacgaaaatagttaatatgcgatggagtttattatgtttattataattttataacgtatttttattattgtttttattttgtatatgtggaagatgaaatttggagatttgattttaaattttacgtttttaattattgggcgaaattgtttagtttttttttgtttattttttagaaatggggttttattttgttgtttaggttggttttgaatttttgggtttaaacgattttttcgttttagttttttgagtagttgggattacgggtacgagttattgtttagatgttttttgttttgttttgttttttggtttttggttttttttagatagggtttttttttgttatttaggttggaatgtaaaggtgttattttacggtttacggtagtttttgttttttagattgtttagtttttaaagatgtttttgatttgttttgtttagtttttgtatttaagattattgtgtaaattggttgagtattatggtttatatttataattttaatattttgggagtttgaggtgggagatttgtttgagtttaggagtttaagatcggtttaggtaatatagtaagattttgtttttataaaaaataaaataattagttggggttggtggcgtatgtttgtagttttagttattcgagaggttgagttgggatgattacgtgagtttagtagttttagattgtagttagttgtgataatgttattgtattttagtttgagtgatagagtaagattttgttttaataataataaatttataaagataaataatttaattgaaaaatgggtaaagaatttaaatagatatttttttgtggttaatgaatatatgaaatgatttatattattagttattagggaaatataaattggaattgtagtgagatattattttatatttattaggatagagaaatgggaatgttcgtatagtgttagtgtaaatatgaaatggtgtagttattttggaaaagaatagtatttttttaaaatgttaaatataaagttattgtaagatttagcgattgggcgcggtggtttatgtttgtaattttagtattttgggaagttgaggtgggtagattatttgtggttaggagttcgagtttattttggttaatatggtgaaattttatttttattaaagttataaaaaattagttgggtgtggtggtatatgtttgtagttttagttattagggaggttgaggtacgagaattatttgaatttaggaggtggaggttgtagtaagtggagatcgcgttattgtattttagtttgggtaataagagcgaaattttgttttaaaataataataatatatgaattggtgttttataaaatgaagatattttttttttgataagaatatatatataagatttatgttaatttagtaattatttaggaggttttattttttgagattttttttaatgaaaatatttttttaagttagatttttagggtgtttaagttaatgttaagaaaagtttggaaagattttgagagaaggttagtttagtattttttttgtaagcggaggtagatttggttttatagaggtttattggaagtgataaaagggaagaattttttaggaattattttagtgtttattgtatatgttagggatataaattttttttaaaaaaaggaattattgtggtgtaaaatattattaaaatttttttaaaagtttagagttgggttggatatggtggtttatatttgtaattttagtattttgggaggttaaggtaggaggattgtttgaggttaggtatttaagagtagtttggaaaataaattaagattttatttatatattaaaaaaaaaatagttggatttggtggtatttattttgtagttttagttatttgggaggtaagggtaggaggattgtttgaggttaggtatttaagagtagtttggaaaataaattaagattttatttatatattaaaaaaaaaaaatagttggatttggtggtatttattttgtagttttagttatttgggaggtaagggtaggaggattgtttgagttaggaattggaggttttagtgagttatgatggtattattgtattttagtttgagtaaattttatttgttgtagatttgtttgtgtttatgcgtttttaaagagcgggaaggaaattattagttttgttatttgaaaggggaaaagagacgggtaaatttggttttttgtttattttataggaatgtcggaagagttagtagaacgggaagtgtttggatttttgggggtatgggcgtttacgtattatttagttttgtggtttgaggaagtatgttattagagaagatagttcgaagattttatgtttagggtttggttggttttttgttgggtttgtattattttttgtttttttagggttttgtaggtggttagggttggttttttggaatgaagttttttttaaagttggagttttttttgattggttattttggttattgtagggttttttaatgttataggtagattcggtttttttattaggtttttttttgttttcggtagtaaaatcgatagtgcgagggatttggagtagggagttgttttagttattagaaagggttatttggtgatatggtttggttgtgtttttatttaaattttattatgaattgtaataaattttaagtgttaagggtagggttaggtggagataatttaattatgggggtagttttttttatattgtttttttggtagtaaataagttttataatatttgatggttttataaaggggagtttttttgcgtatattttttttgtttgttgttgtgtaagatttgattttgttttttttttgtttttcgttatgattatgaattgtaaatagttatatggaattgtgagttaatagttttttttttttataaattatttcgtttcgggtatgtttttattagtattatgagaatagattaatatagtgaattggtatttggagtgaggggttgttgtaaagatatttgaaaatgtagaagcgattttggaattgagtaataggtagaggttattggtggaaggtgtttaggtttttggcgttttgaataaagaattggataagatgtataaataaagtaaggaaagtaaaagtagagatttattaaaaataaaggtatattttatagtgttggaagtaggtttgagtattagggtttaagagtttttattatagagttttttggggttttaatattttagaggtttttttttggttatttggtgtatttttgtgtaaatgagaatggagtgaagttgtagttatttatttagaatgtattttatataaatgaagatgatgttatttggcgtgtgtgatttgtgtgaatattgaggatgaatgtgaagttataaagtgtaaatggagaggatgttatttggagtgtgtgggttacggaaatggagaagatgaatgttaagttataaagtgtaaatggtgtaaatggagaggatgaagtgaagttataaagttatttatatttttgttattgttgaagtgtttttatttgatttagttttaagaagttagtatggattagttttatgttttttgtttttaggttttatttttttgttttattggatagtttgaagggtttagaagaagatagaaaaaagtgggaaagtttggaattttttagagatttggagggtttagaagataggaagatgtgggtaagtttggaattttttagagatttgttgaatggttttaacgaaaatgttgatagtgatatggataataaagtttaggttgaggtggtttagatggagatgaggaatttattgggaattagggtaaacgttatttttgttatgtaaagagaatattggtattttgtttttgttttagagatttgtggaattttgaatttgagatgatttaggttatttaggggaagaaatttttaagtagtaaagtgtttaaggggaataatagtataaaaatttggaaaatttgtagtttgatgatgtaatagaaaaaatatttattttttggggagaaatttaagttggttgtagaaatttgtataagtaaggaggaggtaaatgttaattattaagataatggagaaaatgtttttaggatatgttagagatttttaaggtaattttttttattatagttttagaggtttagtaggaaaaaatggttttgtgggttaggtttagggtttttttgtagtgtgtagtttagggatttggtgtattgtattttagttgttttagtggttaaaaggggttaaggtatagtttgggttatggttttagagggtgtaagtattaaattttggtagtttttacgtggtgttgagtttgtggttatatagtagttaagaattgaggttggaaatttttatttagattttagaggatgtatggaaatgtttggatgtttaggtagagttgtgttgtaggggtagagtttttatggagaatttttgttaggttagtgtagaagggaaatgtggggttagagttttatatagagtttttattgtg

SEQ ID NO: 129 - DNA, 6306 bp, Artificial Sequence
  chemically treated genomic DNA (Homo sapiens)
ttttttttttgaggtggattttcgttttgttatttaggttagagtgtagtggtattatttttgtttattgtaagtttcgttttttaggtttatattatttttttgttttagttttataagtagttgggattataggtgttcgttattacgtttagttaattttttgtatttttagtagagacggggttttatcgtattagttaggatgattttaattttttgattttatgattcgtttatttcggttttttaaagtgttgggattataggcgtgagttattgtgtttggtttaagattttgttttttaaaataaaaaattggtgaggtttggtggtatgggtttgtagttttagttatttagaaggttgaggtggtaggattttttgagtttaggagtttaagattgtagtgagttaggatcgtgttattgtattttagtttggtaatagagtaagattttgtattagaaaacgttttaaatttttttattggattaatatttataaagaagatttaattgtaaagtagatggttttatatatttttatgtaaagtaaaaattaattataaaaaaattgtaaataatatatttttaaaatatgattgataaatattagatatatttattgtgtataatatgttgtgaaatatataaattgtggtatggttaaatagaattaattaatatatgtattattttatatatttatttttttttttgatgagaatatttaaaatttattaagtgttaagattttaatatttaaaattttttttagtaatttttaagaatatattttatattgttattaattatggttattatattgtataatggattttttgaatttattttttttagttgaaattttgtattaagatgttttttgattataattatgaaagttgttggttttaatatataattagttaattagggtagtaagtaggtattttaaaattatattatgtagttaatattttaaaatttttttatatatttgtgttaaattattaaataaattattagtgatagaataaaaaattgttgatttttttttaaatttataaataatagaaatttattttttatagttttaggaggttggaagttcgagattaaggtgtttgtatggtttagttttggtgaaggtttttttcgggttgtagattgttgatttttttttgtgtttttatatggtggagagtagatagagttgttgatttattttttatttgtaatgtatggttgatatatttgatgaaattgagtttatttttttttttttttttttttgagatggagtttcgttttgttatttaggttggagtgtagtggcgcgatttcggtttattgtaatttttatttataatatttaatagatttttttgttttagtttttcgagtagttgggattataggtgtttacgattacgtttagttaatttttgtatttttagttgagatggggttttattatattggttaggttggtttcgaatttttgattttgtgatttgttcgcgtgggttttttaaagtgttgggattataggcgtgagttattgtgtttagttaaatttgagtttatttttattttaaataataaaagttatattttagaaggaataataaataataaatagtttttattttagcgtaggttttttgttttttggttttataagatagggttttattgtattatttaggttggagtgtagtggtaagattatgattcgttgtaatttttgttttttgggtttatgtgattttgtcgttttagtttttcgagtagttgggattataggtacgtattattacgtttagttataatttttattttttgtagagatgaggagttgttatgttgtttaggttggttttaaatttttgattttaagtgatttatttgtttaggttttttaaagttttgggattataggggtgagttatgatatttagttaatgttttgttttttattttgaaataattttaaaattattgtttgggttaagaatcgtataaagaatttttatatattttttttttaagttttttattgttattattttaatatatttttgttttattaatttttttttttatatgtatatatatgtgtatgtatatatatatatgtaattttttttttaagttatttattgggattaagttgtagaaataatgtttattattttaaaatagtttagtgtgtattattttaaaaaaaaaaaagaatttttatttataattagtttatttatgaaaattagaatttagttaggtttggtggtttatatttgtaattttagtattttgggaggttaaggtggggggtggattatttgaggttaggagttcgagattagtttgattaatatggagaaatttcgtttttattaaaaatataaaattagtcgggtatagtggtatatgtttgtaattttagttattcgggaggttgaggtaggagaatcgtttgaatttaggaggtagaggttgtggtgagtcgagattgcgttattgtattttagttttagtaataagagcgaaattttattttaaaaaaaaattagaatttaatattgatttattattattatttaatttagattttagtaaagttttatcgattgttttgataatgttttttgaataaaagaaatataaagattttttatttttttttttttttttttgtttaggatgtaatatggaattatatattgtatatagttgttatgttattttggttttttttagtttggaatattgtttaggttttttttattttttatgattttgttatttttgaagagtataggttagttattttgtagaattatttaaatttggatttacgtgtagttttattatgattagatttggttggtatatattagataattattttagattagattatgtaaatttggtaggaagtgttttgtgttttttttagtgtattaggaggtatataatgttaatttattttttttttgtttttttttttttttttttttagagatagaggtttttttatgtgtttaggttggtttcgaatttttgggttgaagtgatttttttggtttagttttttaaaatgttgggattataggtgtgaatttataatgttaatttattttattattggtggttttttaatttttattatttgaataagatgttgttggttgaggatgttggataattattttttagtttttggtgttattaattgtattggttgaattagttatgttagttatagatttttgattgtgattaaggggaataggtatatatatttttaatttttttgttatggatttataaggtaagaaggagagggataaggatgataaagtatatttaatttaatatgttgtttgttttataatttttttttttggattttattttttatagagataggggtttattaagttttttaggttggtttcgaatttttgggtttaagtgatttttttgttttggttttttaaaatgttgggattataggtttgagttagtatatttagtttgttttatgatttttttttttttttttttttttgagacggagttttattgtcgttaggttggagtgtagtggtgtgatttcggtttattgtaatttttgttttttgggtttaagcgatttttttgttttagtttttcgagtagttgggattataggtgcgtgttattatgttcggttggtttttgtatttttagtagagatggggttttattatgttgtttaggatggtttcgattttttgatttcgcgattcgtttgtttcggttttttaaagcgttgggattataggcgtgatttatcgtatttggtttgagttatcgtgttcggtttataatttttaaatatttagatgaatagtatgtgggtttttttatgaatttttgttttaaaatatgtagaagttaggagtcggtttgtttttaggtagatttttttttttgatgtttttgtttttagtgtaagtagggtttgattaagatatggagtatttttggtaggttaataatttgataatttattaaaatgaaggtttttaaatattttttataaatacgaattgaatatttttttttttatttttttaaaggtggttttataaaagtagaattatattttttgtgaaaagtgttttaagtttttttttttagagttttgttgatatcggttatagcgaattttgtttattttttttattatataaggaattataagttggaattagaagtaattggtattttaattttgatttattttagtggtagtgttttggagttatttaattttgttattttggttggtcgtttttttttttagttttaacggtgagtagttgatattttgttaggtgttggagagttagaggtggatattagggtttatttcgaaaagttgatagtttgtggtgggttgaagttagtagaaagttgttgtaggaaggtagaggagtggtttttattttaggtttggggtttttagggaaggttttttgggggtgagatgggagggtgggtttatatgtttttggattagaatgagtagtttagagaaggtaagagggtttttaagtaaatttgttttatttaatttttttttttttttttgtttagaaaagtaaaatgcgttatgaataaaataaaataaaataaaataaaataaaataaaataaaataaaataaaacgttgtagtaaagaaagcgaaaggttttagtaattttttttgtttttttttatcgtacggattttgtgagatatttcgagtattggaatttggagagtttgggtaggtatttattttttttttagtagggggcggaacgtaaaacgttttgtggtcgacgtttttttttttttatacgttattggcgtgatcgttcgcgttatatattgcgtttgcgtaagggttgtggttttttttttattttttagcgtcgttgggtttgtaggtttttgtcgagtagcggacgtcggtttttgtttcgtaggatggtgagtggatgtttcggtttcggggttttagatgtatggaggttttttttttttgttcgtatgttagtttagggttcgtttcgcgcgtcgtaggggtcggatggcgttagattgttagttttgatttggtcgaggtgtagtttttagcgtggttttaaatggttgtcgttcggtgcgcgaatttggggggaggggttggcgaagaagggttgcgtgagtttggacggcggattggggagaagggtgagtttagtagatagtttgagtgcggatattgtcgtttagtgtgagggggcgttggtaagcggtcgggcgtgagaggtcgtaagtagtcgattttagtttagttggggaacgttagaatggaggggggttgtaggttttcgggttttattcgattttcgagtatcgagtatttcgtgggttttttaggagaatgtcggagtcggtaagttttagatttaggaagtttgtgttcgtgggttgagtaagtggtttttaagttaaaattgttagtggagtttggaggtcgaggggtttttgggtttcggaagtttttttaatatggaatacgtgttttttgtttttttttttagagttcgtcgtcggatgagtttttaattattggggtagggttttaagggtgggatgaaatgttgttttagttgatggggaatagtgttgttttagtgggggaattattgttgaatgtgtttttgtttagttaagttttgtggtaggtaatttaggtttttgaaaaatataatatgggaagcgagagaggtacgtagttgttatttgaggttaggttttcgaagtgggatatagcgtgtttcgaataaatcgacgtttggtattattgattgttgtttggagtagtgtttcgtaaaagtttggtataattatcggtgttggtttttgaagaaataaatatggaaattgaaagcgtttaaaattttttgaaagtaatataataataattttatatttgttaaatgtaataaattggggtttgtattttgtatgttttttttattttatatttttttaaggatttatttttattgttttatgaaattattagtttgtgatatggaaggtagaggaaaaagatttttgattttagttgtttgtgaaatttgggattttataagtgatagttgtttgtttatttttgaagtttaagtgttattttgttatatggttaatttatgttaaaagtattataggttaagatattaaagttttaataatatttttttttttttaagg

SEQ ID NO: 130 - DNA, 6306 bp, Artificial Sequence
  chemically treated genomic DNA (Homo sapiens)
ttttaaagaaaaaagaatgttattaaaattttgatgttttagtttatgatatttttgatataaattaattatgtaataaagtaatatttgaattttaagagtaaatagataattgttatttgtagaattttaggttttataagtaattagggttaagaattttttttttttattttttatgttatagattagtagttttataaaataataaaaatgaatttttagagaaatatggaataaaagaaatatataaaatgtaggttttaatttattatatttaataggtataaaattattgttatattgtttttaaaaggttttaaacgtttttaatttttatatttgtttttttaaggattagtatcggtaattgtgttaaatttttgcgaagtattgttttagatagtaattagtgatgttaaacgtcggtttgttcggaatacgttatgttttatttcgaaaatttagttttaaataataattacgtatttttttcgttttttatgttatgttttttaaaagtttaaattatttgttataaagtttaattgggtaagagtatatttagtagtaatttttttattaaaatagtattgttttttattagttaaagtaatattttattttatttttggggttttattttaataattaaaaatttattcggcgacggattttagaggaagaggtaggaggtacgtattttatgttaaaggagttttcggggtttagggatttttcggtttttaagttttattgataattttggtttaaaagttatttgtttagtttacgggtataagttttttaaatttaagatttgtcggtttcgatatttttttggaaaatttacgaagtattcggtattcggaggtcgagtgggattcgaggatttgtagtttttttttattttggcgttttttagttaggttgaggtcgattgtttgcgattttttacgttcggtcgtttgttagcgtttttttatattagacggtagtattcgtatttaggttgtttattaaatttatttttttttttaattcgtcgtttaagtttacgtaattttttttcgttaatttttttttttaagttcgcgtatcgggcggtagttatttaaggttacgttgggaattgtatttcgattaagttagagttagtaatttaacgttattcggtttttgcgacgcgcgagacgggttttaggttggtatacgggtaagaaaagggaatttttatgtatttaaagtttcgagatcgaggtatttatttattattttgcggaatagagatcggcgttcgttgttcgatagagatttgtaggtttagcggcgttagggggtgggaaaagggttatagtttttgcgtaggcgtagtatgtagcgcggacggttacgttagtgacgtgtgaaagagagagggcgtcggttataaggcgttttacgtttcgttttttgttggaaggagggtgaatgtttgtttaagttttttaggttttaatgttcggggtattttataggattcgtgcggtgaggaggagtagggaggattattggagtttttcgttttttttgttatagcgttttgttttgttttgttttgttttgttttgttttgttttgttttgttttgtttataacgtattttgtttttttaagtaggaaaaaaaaaaaaaattaaataggataagtttgtttgggagtttttttgttttttttgggttatttattttggtttaagagtatatggatttatttttttattttatttttaggaagttttttttgagagttttaagtttgggataggggttatttttttgtttttttatagtagttttttattggttttagtttattatagattgttaatttttcgaggtgggttttgatgtttatttttgattttttagtatttagtagggtattagttgtttatcgttagagttgggagaagggacggttaattaggatgatagggttaagtgattttaaaatattgttattagaataaattaggattaggatgttaattatttttgattttaatttgtaattttttatataataggaaaaataaatagagttcgttatggtcgatgttaatagagttttagaggagaaaatttaaaatattttttataggaagtgtgattttatttttgtggagttatttttgaaagggtaaagaaagaggtatttaattcgtatttatagaaaatatttaaaaatttttattttggtggattattaagttattagtttattaaaggtgttttatgttttggttaggttttgtttatattggaggtaaaagtattaggaaggaaagtttgtttggaaataggtcgatttttaatttttgtatgttttagggtaagggtttataggaagatttatatattatttatttgaatatttagaagttgtgggtcgggtacggtagtttaggttaggtgcggtgggttacgtttgtaattttagcgttttgggaggtcgaggtaggcggatcgcgaggttaagagatcgagattattttggataatatggtgaaattttatttttgttaaaaatataaaaattagtcgggtatggtggtacgtatttgtagttttagttattcgggagattgagataggagaatcgtttgaatttaggaggtagaggttgtagtgagtcgagattatattattgtattttagtttggcgatagtgagatttcgttttaaaaaaaaaaaaaaagaaagaagttatgaagtaggttggatgtgttggtttaggtttgtaattttagtattttgggaggttaaggtaggaggattatttaaatttaggagttcgggattagtttgggagatttggtgagtttttgtttttataaaaaataaaatttaaaaaaagaagttatgaaataaataatatgttaaattaaatatattttattatttttattttttttttttttattttataaatttataataagaaaattaaaaatatgtatatttattttttttggttatagttaggggtttgtggttagtatggttggtttagttagtgtagttggtgatattaggagttagggggtaattgtttagtatttttagttaatagtattttatttaagtggtaaaagttaaaaaattattaatagtgggatgaattaatattataggtttatatttgtaattttaatattttgggaggttgagttaggaggattattttagtttaggagttcgagattagtttgggtatataagaagatttttatttttagggaaaaagaaaaaggaaagtaaagaaaaaataaattaatattatatgttttttgatgtattgagaagaatataaaatattttttattaaatttatataatttaatttaaaatagttatttaatatgtattaattaaatttaattatgatgaaattatacgtaaatttagatttagataattttataaagtaattggtttgtattttttaaaaatgataagattatgaaagataaggaaagtttaaataatattttagattgaaagagattaaagtgatatgataattgtatgtaatgtgtgattttatattgtattttggataagaaaggaaaaagggaaataagaagtttttgtattttttttgtttaaaggatattgttagaataatcggtgaaattttattgaagtttggattaggtgatagtaatgaattaatgttaaattttgatttttttttgagatggagtttcgtttttgttgttgaggttggagtgtaatggcgtaatttcggtttattataatttttgttttttgggtttaagcgatttttttgttttagtttttcgagtagttaggattataggtatgtgttattatgttcggttaattttgtatttttagtagagacggggtttttttatattgattaggttggtttcgaatttttgattttagatgatttattttttattttggttttttaaagtgttgggattataggtgtgagttattaagtttggttaaattttgatttttataggtagattggttatgaatgagagtttttttttttttttaaggtaatatatattgaattattttggagtagtgggtattatttttgtaatttggttttagtaaatggtttaggaagaaaattatatgtgtgtatatatatatatatatatgtgtatgtaaagagagagattaataaggtaaaaatgtgttaaaatggtgatagtggggaatttgggagaagagtatatggaaattttttgtacggtttttaatttaagtagtggttttgaaattattttaaaataaaaaataaaatattggttgggtgttatggtttatttttgtaattttaggattttgggaagtttaagtaggtggattatttgaagttaggagtttgagattagtttgggtaatatgataattttttatttttataaaaaataaaaattgtagttgggcgtggtggtacgtgtttgtggttttagttattcgggaggttgaagcggtaggattatatgagtttaggaggtagagattatagcgggttatgattttgttattgtattttagtttgggtgatatagtaagattttgttttgtaaaattaaaaaataaaaaatttgcgttagaatgggagttatttgttatttattattttttttagaatatagtttttattatttgaaatgaaagtgaatttagatttggttgggtatagtggtttacgtttgtaattttagtattttgggaggtttacgcgggtagattataaggttaggagttcgagattagtttggttaatatggtgaaattttattttaattaaaaatataaaaattagttgagcgtggtcgtgggtatttgtagttttagttattcgggaggttgaggtaggagaatttgttgaatgttgtgggtggaggttgtaatgagtcgagatcgcgttattgtattttagtttgggtgatagagcgagattttattttaaaaaaaaaaaaaaaagaaagtgaatttagttttattaaatatgttaattatatattataaatagaaaataaattagtagttttgtttgttttttattatgtgaggatataaggaggagttagtagtttgtagttcggaagaggtttttattagaattgaattatgtaggtattttgatttcggatttttagttttttggaattgtgagaaataaatttttgttgtttataagtttaaaaaaaaattagtaattttttgttttgttattgatgatttatttgatgatttaatataaatatgtgaaaagattttaagatattaattatatagtatgattttgaggtgtttatttattgttttaattagttggttatgtattgaaattagtaatttttatgattatgattaaagaatattttaatataaaattttagttagggggaataagtttaagagatttattgtataatatgatggttatagttaataataatgtagaatatatttttgaaaattgttaagaaagattttaagtgttaaaattttaatatttaatagattttaagtgtttttattagaaaaaaaaataagtatgtgaggtaatgtatatattaattagttttatttagttatattatagtttatatattttataatatgttgtatataataaatgtgtttaatatttgttaattatattttaaaaatatgttatttataatttttttgtaattgatttttgttttatatgagagtgtatagagttatttattttatagttgaattttttttatagatattaatttagtggaaaaatttgaaacgttttttgatatagggttttgttttgttgttaggttggagtgtagtggtacgattttggtttattgtaattttgaatttttggatttagggaattttattattttagttttttgagtagttaggattataggtttatgttattaaattttattaattttttgttttaagagatagagttttgggttaggtatagtggtttacgtttgtaattttagtattttgggaggtcgaggtgggcggattatgaggttaggagattgagattattttggttaatacggtgaaatttcgtttttattaaaaatataaaaaattagttgggcgtggtggcgggtatttgtagttttagttatttgtgaggttgaggtaggagaatggtgtgaatttgggaggcggagtttgtagtgagtagagatggtgttattgtattttagtttgggtgatagagcgagaatttattttaaaaaaaaaa

SEQ ID NO: 131 - DNA, 5127 bp, Artificial Sequence
  chemically treated genomic DNA (Homo sapiens)
  unsure (69, 96, 3132..3133, 3138..3139, 3144, 3146..3147, 3152)
tggagatgggagagtagaagttgggttaagtgcgggtatagtaatttatatttgtaattttagtatttntgggaagttgaggtaagtagatcggtntgagattagtttggataatatggcgaaattttatttgtataaaaaaatatagaaattatttgggtatggtggtatatattcgtagttttagttattcgggagggtgaggtaggaggatcgtttgagtttaggaggttaaggttgtagtgagtagagattgtgttattgtattgtagttagggcgatagtgagattttattttaaaaagatgttgggataagtgggtaaaaggaagattagagatttgttaatcgtaggtttttgttttgtttaataagtgaggggttgatttttttatacggtgttggttattggggttgtagagatagataaggttcgtttggaatgggttgattttagagagagtatggatttgtagaatttatgttataaattgttaagttagttaggagttttatttgatgaggttgtgtagatagttatttgttgaggtcgtgggaatttatttattatgtttattttagtatagggtttgatatatagtaggtatttgtaaatgatgttaaataagtaggtggatgaatcgtaggaatgaataagaattattttttttattagtatgttgtgttttaggttttgttagatagtttttttgtattgattgattttttttaattgtatgtgtaaggacgttgatgttatttattagttagtaatttgagataggttttgtttaagtttaaaaaaaaaatttttttttttaaggagagataattgggtgatttgatacgatatgagtttagggtttagagggaatagtgatgagagatgagggtggagatgggagttgggtcgtttaaatttaggtaaatagttcggattttgttttgatggtagtgaggagttagggaagggtttaagtagtgtagtgagggaggttaggtttgtttagggaggtgggtgggttttttagatgttcgaataggaggtttttttgagaagtgtggtttgaggataagttttatggtggttgttttattttgtttttatttgtttggtttgtttggattgaattttgtttagaggagtaggtttaagtggggataggaagggttttgatttagtttttgtattaagtatagagtaggtttttaattagggagttttgggggttgtttagtgtttagggtagatgtttagattgtgtttaagatagtatgtagtttgtgtttagagtagttatagtaggttgtgtgtggtttttaggagtttttttagttttaattttattttttgtaagtcgggttttttttgtattgttaagtttttgttattgttattgttttttttgtttgttgtgtgatacgttcgtttttttttttgtttattttttttcgtttttttttttttttttttattttttttgttttttttttatattagtattttttgttattttagttgtttttatttgagtttagttggtttttattatttttattttttttttttttatttagattgttcggtttttgggtttgatttggagattaattttattttggagtttttgtgtttgagtatgatagaatacgttttgggtggtgagtattttttttttttttgatttagtttttatttatttagcgtttttgtttttgaattgagtaatttagagttattttgaggggtttttaggggaggttagattttagggagggtttgattgggatgataggttatttgagtgtttttttttgggtttttttttagtttttgattttttttttttttttttttttttattatagatgggatagataaaatttttattatttgacgggatttatagtttagcgtatttataggttttttgggcggcgggcgggggttaatttttaacgggttttttcgcgatagcgagagggtgggttggtttagttatatattttaatatttttttatttttttatttttttaatttttgtttaatattggtatatgttttgtttatttttaggttcgtcgagggatttttgttgaggttcggggagttgggggtagttaggataaagggggtagggattggttagattgtttgttttttttttttttttttttatttttatttggttttattttatttttgttttttttagatcgttgattatttgtttttttttaagggagtagattttttagagataaattgattattattttgtggagtttgtttagaaatatttgatatttggggtgacgcgtagggtagagaatttgttttttagaatgttattgagaggagttggggagaaggaaggggagtaaggagaggaagtttttttttttttttttgttttttttttattattttttatattttgtaaggataggagttattttttttttttttattttttttggttttgtttattagaggttttttatgattaattttttaggtttatttaagatatatatttatatagtttttaacggtttttttttgattatttttttttatttttagaatttttaggttttttttagttaagatagtggtagggagagtttgaattttatgaggggagagggtagagtttttttttttagatttttaagttttaatttatttttttttagttttggttattcggatgaagaggttggaggtgggtagttagggtagttagtgaggttaggaagtttgttgttttaacgtttttttttttacgaatatatattttttttcgtttttaggtttggttggtgagatttgggagttaggaataagggaaaggggattgtttggtttttgggtttttttttaagtttttttttttttttttagttttttttttttttttattatgttatgattttatttaagtggaatattatattataatttagagattcgttttagttttagagttcgatagattgtttggtttttatttttaatgaggggttgtgttggggtttaggtggagggaggggatttgggggtttagattgcggggaagttagggttttttattttaacgttttttttttttttaatttattttcgtnnttcgnntaagntnnggggncggtatttttagttgtggggaggaggtttaagtggagggtgatttgggggagaggaaaaagatgattgggagattttggagaaagagattttaggggttgggcgcggtggtttacgtttgtaattttagtattttgggaggttgagatgagtggattatttgatgttaggagttcgagattagtttggttaatatggtgaaatttcgtttttattaaaaatataaaaattagtcgggcgtggtggtgtatgtttgtaattttagttatttaagaggttgaggtaggagaatcgttttaatcggggaggtagaggttgtagtgagtagagattatgttattgtattttagtttgggcgatagagtaggattttgttttaaaaaaaagaaaaaaaaatataaaaaatagagagattcggtcgggcgtggtggtttacgtttgtaattttaggattttgggaggttgaggcggattatattatttgaggttaggagttcgagattagtttggttaacgtggtgaaattttatttttattaaaaatataaaaaacgattagggcgtggtggtagacgtttgtaattttagttattcgggagtttaaggtaggagaattttttgaattcgggaggcggaggttgtagtgagacgagatcgtattattgtattttagttagggtaacgagcgaaatttcgttttaaaaaaaagagagagattttagggtggggacggggaagaggttaatttttgggggagggttttttaggagagggggattttaatagagggaaaattttagggaaggtagttgttgggaagaggagtttcggaagggaaataaatttaggagaaaggtagattttgagggacgggtttttgagagaaaagtttttgtggatttgcggggcggggtgttttgggaaagggggatttgtcgggaaagggggatttgtcgggaaagggagattttggaggagggagattttaggggtattgggttttgataagagaaagattttgggaagggtgattgaggggacgaggatcgaatggagggagatttagggaaaaggggggtttaagttgagtatttttaagagggatatttggggttggttatttgagagaaggatgggaaatattttgggaagaggaaattgaaaggaaggatattttggtgaaagggagattttgaggggaaggggttttgaggggaaaaggattttgggagaggatttttaaggagggggattttagggaggataggattttggaagtttttaatttgagaatttagttagattttttgtagtagattttaaaggaagattttgatgcgggggattcggggaggggggagtttagaggggagaaagattataggtgttgggagggtgggaattgatttaaagaaagggcgaagggagattattaaagagttagaatgtaaagaagagttgcggtagtcgattatagaggacgcgaagtatattttcgcggttttttttttagttcgtatacgatatttttaggtttcgtttttttcgtttatagagttcgttattttcgttttatagggttcgttcgttttgagcgtttaagggttttttcgtcgttgattagacgtttcgttcgttagtcgtaatagaagtcgtaaagttttttttcgtcgcgacgtagtgtttaaggcgtttgcgtagattttgaaaagcggttagggtgatttttagtttttttttttcggttgcggcgtcgcgcggtgaggttgtttagtttacgttcggagttatgtcgtttaagggttcgttgtagtcggtgtaggttttcggacgtaaggtgagttagacgtcggatgggaaggggaggggaaggagaaggttagggtttgggagaggtcggtgggtaggaatttagggggtaatatgggagttggagtcggagtttacggggtttttgttttttttgtattttataga

SEQ ID NO: 132 - DNA, 5127 bp, Artificial Sequence
  chemically treated genomic DNA (Homo sapiens)
  unsure (1976, 1981..1982, 1984, 1989..1990, 1995..1996, 5032, 5059)
tttgtaagatataagagaaataggggtttcgtgagtttcggttttagtttttatgttattttttagatttttgtttatcgattttttttagattttggttttttttttttttttttttttttattcggcgtttggtttattttgcgttcgaagatttgtatcgattgtagcggatttttggacggtatggtttcgagcgtggattagataattttatcgcgcggcgtcgtaatcggaaaaggaaagttaggggttattttggtcgttttttagggtttgcgtaggcgttttgagtattgcgtcgcgacgggagagagttttacggtttttgttgcggttaacgggcggggcgtttggttagcggcgggaaggtttttaggcgtttagagcgggcgggttttgtgaggcggaagtggcgggttttgtgggcggaaggggcggggtttgggagtgtcgtgtgcggattgaagggaaggtcgcgggagtgtgtttcgcgttttttgtagtcgattatcgtagtttttttttgtattttggttttttaataattttttttcgttttttttttaaattagtttttatttttttaatatttgtaattttttttttttttggattttttttttttcgaatttttcgtattagaatttttttttggaatttattgtaagaaatttggttggatttttagattaaggatttttagaattttattttttttagaatttttttttttggggatttttttttagaatttttttttttttagagttttttttttttagaattttttttttattagaatgtttttttttttagttttttttttttagaatgttttttattttttttttagatggttaattttaaatgttttttttaagagtgtttaatttagattttttttttttttgaatttttttttattcggttttcgtttttttagttattttttttagaattttttttttgttaggatttagtatttttggaattttttttttttagaatttttttttttcggtaaatttttttttttcggtaaattttttttttttagaatatttcgtttcgtaaatttataaaaattttttttttagagattcgttttttaaaatttattttttttttgagtttatttttttttcgagatttttttttttagtaattgttttttttggagttttttttttgttagaattttttttttttaagagatttttttttaagaattaatttttttttcgtttttattttagaattttttttttttttttgagacggagtttcgttcgttgttttggttagagtgtagtggtgcgatttcgttttattgtaattttcgtttttcgggtttaagagatttttttgttttaggttttcgagtagttggaattataggcgtttattattacgttttggtcgttttttgtatttttagtagaaatggggttttattacgttggttaggttggtttcgaatttttgattttaggtgatgtgattcgttttagttttttagagttttgggattataggcgtgagttattacgttcggtcgaatttttttgttttttgtgttttttttttttttttttgagatagagttttgttttgtcgtttaggttggagtgtagtggtatgatttttgtttattgtaatttttgttttttcggttaaagcgatttttttgttttagttttttgagtagttgagattataggtatgtattattacgttcggttaatttttgtatttttagtagagacggggttttattatattggttagattggtttcgaatttttgatattaaatgatttatttattttagttttttaaagtgttgggattataggcgtgagttatcgcgtttagtttttagaatttttttttttagaattttttagttatttttttttttttttttaaattattttttatttaagttttttttttataattgaaggtatcgnttttnngntttgnncgggnnacgaaggtgggttgagggggaggagggcgttgaagtgggagattttggttttttcgtagtttgaatttttaaattttttttttttatttgggttttaatataattttttattaggaatagggattagatagtttgtcggattttggggttgggacgaatttttgggttatgatatagtgttttatttaagtgaggttatgatataatgggggaaggaaaaaggttgaaagaaaagggaggggtttagggaaaaatttaaaaattaaataatttttttttttttatttttgatttttaagttttattaattagatttgggagcggagaagggtgtgtgttcgtggggaaggggacgttaaggtaatagattttttgattttattggttattttggttgtttatttttaatttttttattcgggtagttagggttggaggaaaatgggttagagtttgggggtttggaggagggggttttgttttttttttttataaagtttaggttttttttgttattgttttggttgagagagatttggggattttaaaaatgagaggaaatgattagagaaaaatcgttaagaattatataaatatgtattttaaataggtttaagaaattaattatagagaatttttggtgaatagggttaggggaggtgagagagaggaaggtggtttttgtttttgtagaatgtggggaatggtgaaggggaagtagggagaggagagagagttttttttttttgttttttttttttttttttagttttttttaataatattttggagggtaggttttttgttttgcgcgttattttaaatgttaaatgtttttgagtaggttttataaggtagtggttagtttgtttttggggagtttgtttttttggggagaggtaggtggttagcggtttggaggaggtaggggtgggatgggattaggtggggatgaggaaggaaaggagagaggtaggtagtttggttagtttttgttttttttattttggttgtttttaatttttcgggttttagtagagatttttcgacgggtttgggagtgagtaaggtatgtgttaatgttaaataaaagttaagagggtaagagagtagaaaaatattagaatatatagttgagttagtttattttttcgttgtcgcggagaagttcgttgggggttggttttcgttcgtcgtttagggagtttatgggtgcgttgggttgtgggtttcgttagatggtggaggttttgtttgttttatttgtggtaagaaagggaggaagggaggaagattaggagttggagggaggtttaagaaaaggtatttaggtagtttgttattttagttaggttttttttggagtttggttttttttggggattttttaggatgattttgagttgtttagtttagaggtagagacgttgggtaggtgggagttgggttagggaaagaggaaatgtttattatttaaggcgtgttttgttatgtttagatatagagattttagagtgggattgatttttaggttaggtttaggaatcgggtagtttgggtgggagagaggagaatgggggtggtaaggattaattggatttaggtgaagatagttgggatgataaaggatgttggtatgggaagggagtaagagagatggagggggagagggaagaacgggaggaggtggatagggagagaggcgagcgtgttatataataggtagaggagataatggtaatggtagaggtttggtaatatagaaaaagttcgatttgtagagagtggaattgaaattgaaggagtttttggaggttatatatagtttgttgtgattattttggatatagattgtatattgttttgagtatagtttgggtatttgttttggatattgggtagtttttaaggttttttgattgaagatttgttttgtatttggtgtaaaagttaaattaaaattttttttgtttttatttggatttgtttttttgggtaggatttaatttaggtaggttaggtaggtgggggtaaagtaggataattattatgggatttgtttttaaattatattttttaaaagggttttttattcgggtatttgggaaatttatttatttttttgggtagatttgattttttttattatattgtttaaatttttttttgattttttattgttattaggataaagttcgagttgtttatttggatttagacgatttagtttttatttttatttttattttttattattgttttttttgaattttgagtttatgtcgtattagattatttaattgtttttttttaaaaaaaagaattttttttttgaatttgggtaagatttgttttagattgttgattgatgaataatattagcgtttttatatatatagttgggaggagttaattagtgtaggagagttgtttgataaagtttgggatatagtatgttggtaaagagaatggtttttgtttatttttgcggtttatttatttgtttgtttaatattatttatagatgtttattgtgtgttaagttttgtgttaggatgaatatgatggatgggtttttacggttttaatagatggttgtttatataattttattaagtaagatttttgattgatttggtagtttatgatatgaattttgtaaatttatgttttttttagagttagtttattttagacgagttttatttgtttttgtagttttagtggttagtatcgtgtggaggagttaattttttatttgttgagtagggtagggatttgcggttagtaagtttttaattttttttttgtttatttgttttaatatttttttgagatggggttttattgtcgttttggttgtagtgtagtggtataatttttgtttattatagttttgattttttgggtttaagcgatttttttgttttattttttcgagtagttgggattacgggtgtgtgttattatgtttagataatttttgtatttttttgtatagatggggtttcgttatgttgtttagattggttttanatcgatttatttgttttagttttttanaagtgttgaaattataggtgtgagttattgtgttcgtatttggtttaatttttgtttttttattttta

SEQ ID NO: 133 - DNA, 5935 bp, Artificial Sequence
  chemically treated genomic DNA (Homo sapiens)
aaattaaaatatttttttggaagagaagtattttgtaaatatgtatatttcgatggttgattatatattttttttttgttgtagattttgtttaaatagaaatagttgttgattagtgttgtggagtttatttatcgattgtattgattatttatgatggaagtttgacgtgaattgtttattattaattgggtggtgtgtaaaatgttgatgcgatgattgaattagaaatgtatttggattttttatatagtatagagtttgttttttaaataattttggttaaagtaaaaattaaagatatttttgaaaaaatagaatttagaaaaataaatttagtttagttgatattaaattttgtttttgttaaattaaataggattttaatgttttttgtttgttaagtattagtgaggaatttgtttaaatagtaaaaaaatataattttatagttattaaattaaagtaattagaattttagtgatgggtgaaagtggaatcgtatgttttttttcgttgggagttatttattggttggggtatttgaaaatttatgattttaggtggagagttgaagttaaatattatgatgtgttttgtgtgtgcgtgttatgtaggttattttgagttatatgttttgttttttttatgtaggagataaattatatagtgaaattagatgtttaaaaattatgtgttattttttgatagtaatttataggagttagttgtgtatacgttagttgtttttagatatttaatatttgtttggtatattgttgatgtagaattttttttttttttgggattttggtatatttgatttaataaatttttaaaataaagtggaaattttattaaatatgttgtggattaaaaattatttttattaaagggtagagtaagatattagtagaaatagtagttatcgatgttttatgaataaaagtcgtatttaatttttgtgagaggtgttaaatattatagtttttaatttattatttaaaagttagtttatatatttgttaatttataattgttaaacgtattgtaagtgataggaaagttatttaattatatttattttatagaattatttttatagattatgatttaaaagtacgtattgattgttattaggagtgatataagtagtagtgttatggggaaaatttttgtatgattttgtaaatttgtttttgggaattgtgtttattatttatttttataagagaaattatggtttagtattttttttttggatttttagaaagataggtaaggtttgtttttttaaagatttgatatttttggttttgatgtaataatgagaaatatatattttttgaattttttttttgtggttattgttgaatttatatgggagagtggttaaatgttaataatttgggggtagattatttggttttttgtttttttttattattaatttattatggtatattaagaggttatttaatttgttttttttttagtttttttatttgtaaaatgaggataatagtattagttattaggtttgggaaaggataaaattaatttatttatttaaggtatttgttatatttatgtaatatatattaggttttatgtaaattttagttataattattggtagtattattattagtaggtaatatttatggaaatttgattacgttttcggtattattttaaatagtttatagagatgattttatttagtttttaatttataaattgtatatttttattgttgttattttatgaatggtgtatatagagaagggggaaattattagtttttgtagtttgaattttttattatatattttttatttttttttttgtttatttgatatttgttgtttattatttagtagttatttagttttattaataaaaataatgttaatttgtttttaaaggtgagggtaaaaaaatataaattgttttaaagttttaaaagttttttaaattatgtataattgttttttagaatattatacgttttgtattatattaaaatgaattataataaagaatggtatatgtatatattgaagtggaatatttatttacgattagttaaatgttttagtgtggtgatttatttttttaatttttgattagatggtatagtattgttaggatgaatttttagataagggttatattagtttatttagaataaatgttagaagagtatagaattgttattataatttttgtagaaatattttttgattgttatttaaatagaagagtagtttgggttgaatttttatttaagtgatttaaatatttttttgtatatagtataatttgttattgtaaagaagaatttaaaatagtatgattaaataaaaagttatatttattttttaaattttttatttgtaattatagtttttaaatgtatgttgatgtttaagttatttttaaagttttttgagtattataaaggatttttatttgtttttgtggtttagattttagaaaatttgtttggttgtttaagatttttaaggaatttgtttaataaagattttagagaggtttaatgtgtggtaaaggatatttgatttagttaaagagtaagaaatttttaaggattttttttagtgtttttggaggtggtttttatttattttattttataattattttatagttagaatttgttattgttttttatattaatgaatttgtgagagaattagatatgaaattttttatattaagttttatatttataaattaatatttttttttaatagtgtgttagtattttaataattgtttaattattttttattatatgtaagttataaaataattttagattttataaataaaataattataaatattgttttatgttgttttttaatttattttgtgggttgtaatttgaatttattttatttgtttttatttaatgtgatgtgaaattaattatcgattcgattagagatggtattttttgtagaataaatattttgttaatttgttttttgttgtaattaggttttttattgttatttttagttttttaggaggtttttaattattagaattatttattttagaaaaaattagatttatcgaatatatttttggttaatgattgtttaagaataatgttaatattatatgtaggaatgttatattttttaggatttgatatttttagtatttggaatttattatatgttgtaaatggaaatattattattaaaaatagaatgttataaatagtatgatgtattttgtttttaaagataatatattaaaatgatgtaaaaatggtaataaaagtgagagattttttggtaaagttattttagggtaaacgttgtggttgtaagtgttattagtaagtatttttggtgtaaatgggaataaagttaaagtagtggggtaaatacggaattaaaagaataatatttattattataaaaatatatttaagtatatagtttatagatattataaagtaatagtgtttgtgataaataattatttttatatattaattagttaataatataatgagagaattaaaatttgatatattattgttaattttgaatgtaaatgggttaaatgtttaatttaaaagacgttagtgataatttggataaaaagataagatttaattattttatttttttaagagatttattttatatgtaataatattaaaaggtttaaagtaaaaggatggggaaagatgtatcgtgtaaataaaaaatagtaagagttattatttttatattagataaaaataaattttaaattaataataattatgaagaataaaaagggtagtatataatgataaagggtgtaatttaataaaatgatttattttaagtatatatatatttaatattggaatatttatatttataaaataagttttttttattgtatgaaaagaattagatagttatatattaatagtaggagattttaatattttattgatagttttagatagattattaaggtagaaaattaataaagaaattttggatttaattttaatatttgattaattgtatttaatagatatttattgaatattttatttaatatttatagtatatatattttttttatttgtatattttagaatatattttaagattaattatatatttagttataaattaattttaataaattaaaaaaaattgaaattatgttaattatatttagattataatgtaataaaaatggatattagtattaagaagatattttaaaattataaatatatatgaaaattaagttgatttttattaatttttggataaatttttaaattgaggtagaatttaaaaaatattttgaaattaatgaaaataggatataatttatttaaatttttggaatgtagttaaagtagtgttaaaaggaaagtttatagtattaaatgtttttattaagaattttttaggttagagaaaggtattagttttatggagtgatatattaaaattcgttttcggtagacgtttttttttcgagatttgttttgagggttgttttaatttggtataagaggataaattttcggttttttttcgcgtgcgcggtgtggtggtagtaggcggagtttcgaaatgtagaataacgtcggcgagttcgtggatttgtaagtttcgcggaaatgtttcgttagtaatcgtattatcggtgttaaggattacgtatttatttagatgaacgtggtcgaggttgataaggttattggtaggtttaatggttagtttaaaatttatgttatttgcggggcgataggatgggtgagttagatgattcgatttttcgattggttaaggtcgatagtatcgttttaaagaagttttgattagagagaattacggatgtggaatatttgttataaataaatagtgaaaatttaaaaaaaaaaaaaaaaaagataaattttttttttattttatagagtgaggagttaagaaatgttaaaacgttggtatatttataaattttttttaaggtatttttttaagtttttttttatatagttgaagggggttgacggagttgatagttataggttttgtattgtaattttttagtaagttttaaaaatgtgtttaatgttattatttataatgtagagaatttgtatattataattagttttgagttttagttataattttaagaaataagaaatattttgatgtggtttggttttgtgtttttatttaaattttatgttaaattgtaatttttagtgttggaggaggggtttcgtaggaggtgattgaattataggatagattttttttttattttttttataatagagtttttatgagatttggttgtttgaaagtgtgtagtatttttttttttgtttttttttttttttgttttattatggtaaggaatgtttgttttttttttattttttgttatgattttaagttttttaaggttttttagttatgttttttgtatagtttgtggatttgtgagttaattaaattttttttttttataaattatttagttttaggtcgttttttgtagtattgtgagaatcgattaatatatattttattttttattatatatattttatttttaattttttttttagtattaaatgtattagtttatatagtttttatgtaaataaatattgttatatgaatttgaagtcgaaagagatttaagataaatgatggtatataatattgttttttttttttatatgtttatgtattgggttataaatatgagtaaggttttataaaaatttgtattatatagaagtttgttaaaaaagttattcgggtgatgtttgagtttaagggaaggtgataattaatcgatgtttttttttagagtttaaaattaattaagaaatggagttagatttagagaagtt

SEQ ID NO: 134 - DNA, 5935 bp, Artificial Sequence
  chemically treated genomic DNA (Homo sapiens)
ggtttttttgaatttgattttattttttaattggttttgaattttggagaaaagtatcgattaattattatttttttttagatttaaatattattcggatgatttttttggtaaatttttgtataatatagatttttgtaaggttttatttatatttgtaatttaatatataagtatatagaaaggagaggtagtattatatattattatttgttttaaatttttttcgattttagatttatgtgatagtatttatttgtatggaggttatatgggttaatatatttgatattgagaaaaaaattaaaaataaaatatatatggtgggaaataggatgtgtattagtcggtttttatagtgttataaagaacgatttgagattgggtaatttatgaagaaaagaggtttaattgatttataggtttataggttgtataggaggtatggttgggagattttaggaaatttaaaattatggtagaaggtgaaggggaagtaagtattttttattatggtggaataggagagagagagaataaaggagaaagtgttatatatttttaaataattagattttatgagaattttattatgagaagagtaagagggaagtttgttttgtaatttagttattttttacgaggttttttttttaatattgggagttataatttaatatgagatttgggtggggatatagagttaaattatattaagatgttttttgttttttggaattgtggttgaagtttaaagttgattataatgtataagttttttatattataaatagtgatattggatatatttttaggatttattgagaaattataatatagaatttgtggttattaatttcgttaattttttttaattatgtaagagagggtttgagaaggtgttttaaaggggatttataggtgtattagcgttttgatattttttgattttttattttgtgggatgaaaagagggtttgttttttttttttttttttttaggtttttattatttatttatgataaatattttatattcgtgattttttttagttaaaatttttttgagacgatgttgtcggttttggttaatcggagaatcgaattatttgatttatttattttatcgtttcgtagatagtataagttttaaattggttattaaatttgttagtgattttgttagtttcggttacgtttatttggatggatgcgtggtttttggtatcgatgatgcggttgttagcggagtattttcgcggaatttataggtttacgaattcgtcggcgttgttttgtatttcgaggtttcgtttgttgttattatatcgcgtacgcgagagaaagtcgagggtttgtttttttatgttaagttagggtagtttttaaagtagatttcgaagggaagacgtttatcgagagcggattttgatgtattattttatgagattggtgtttttttttagtttggagaatttttgatgaaaatatttagtgttataaattttttttttaatattgttttagttgtattttagagatttgggtaagttgtgttttatttttattaattttaaagtattttttgaattttgttttaatttgggggtttatttaggagttaatgaggattaatttaatttttatgtatatttgtaattttgagatatttttttgatattgatatttatttttattgtattgtggtttgagtgtggttgatatgattttaattttttttaatttgttgagattgatttatgattgagtatgtggttgattttagaatatattttaagatgtgtagatgaaaggaatgtatatgttgtggatgttgggtggagtgtttagtagatgtttattaggtgtaattagttaagtgttgaggttaagtttagagtttttttgttagttttttgttttagtgatttgtttaagattgttaatggggtgttgaagttttttattgttagtgtgtgattgtttaattttttttatatagtaagaagaatttgttttatgaatgtgggtgttttaatgttgggtgtgtgtatgtttagaataagttattttgttggattgtattttttattattatgtattgttttttttgttttttataattgttattggtttaaagtttgtttttatttgatataagaatagtgatttttgttgttttttgtttgtacggtatatttttttttatttttttattttgagttttttgatattgttatatgtgaaatgggttttttgaagagataagatggttgggttttgtttttttatttagattgttattaacgttttttaagttgggtatttagtttatttatatttagggttagtaatgatatgttagattttgatttttttattgtgttgttagttggttggtatgtagaaatgattatttattatagatattgttgttttatagtgtttgtgagttatgtgtttaaatgtgtttttgtggtagtaggtgttatttttttaatttcgtgtttattttattattttaattttgtttttatttgtattaaaaatatttattggtggtatttgtagttatagcgtttattttgagataattttgttaaaagattttttatttttattattatttttgtattattttaatatattgtttttggaaataaaatatattatgttatttatagtattttgtttttagtagtggtatttttatttataatatatagtaaattttaaatgttggaaatgttagattttagaaaatgtaatatttttatatatgatgttaatattgtttttgaatagttattgattaaagatgtattcgatgaatttgattttttttgaagtagatgattttgatgattgagagttttttgggaagttgagagtgataatggaaaatttaattgtagtagaaaataggttaatagggtatttattttatagggaatgttatttttagtcgaatcgatgattgattttatattatattaaatggaagtaaataaagtaaatttaaattatagtttataaaatgagttgaaggataatataaaataatgtttataattattttatttataaaatttgaagttgttttataatttgtatgtgatagaagatagttgggtaattattgaaatattagtatattattaaagagaaatattagtttataggtatagaatttagtgtgggaaattttatgtttggtttttttataaatttattgatgtgagaaatagtaataggttttgattataaagtgattataaggtagaataaatagaaattatttttagaggtattagaggaaatttttggggattttttattttttgattgaattaaatgttttttgttatatattaggtttttttggagtttttgttagataaattttttaaaaattttagatagttaggtagattttttaagatttaaattataagggtaagtagaggttttttgtggtatttagagagttttgagagtgatttaaatattagtatatatttgaaaattataattgtaaatgagaagtttaaaaaatagatgtggttttttatttaattatattgttttaaatttttttttataataataaattatgttgtatataagaaaatatttaaattatttaaataaaaatttaatttaagttgtttttttatttggatggtaattaaaaaatgtttttgtaggaattataataataattttgtgtttttttgatatttgttttaggtagattgatataatttttgtttaagagtttattttgataatgttatgttatttaattaggaattagaaagatgagttattatattaaaatatttagttggtcgtaaataagtgttttattttaatatgtatatatgttattttttgttataatttattttgatgtagtataaaacgtgtaatattttaaagagtagttatatataatttggaaaatttttggagttttaaaatagtttatatttttttatttttatttttgaaggtaggttgatattatttttattaataagattgaatagttgttgaataatagataataaatgttaaataaatagggaaagagatagagaatgtgtaatggaaagtttaggttgtagaaattgatgattttttttttttttgtgtatattatttatagagtagtaataataagaatgtgtagtttataaattagaggttaaatgagattatttttgtaaattgtttaaaataatgtcgggaacgtagttaaatttttataaatattatttattaatagtagtattattaataattataattaaaatttatatagggtttaatatatgttatataagtatgataaatgttttggataaataagttaattttatttttttttaggtttagtagttaatgttattgtttttattttataaataagaaaattaaagaaaaggtaagttgagtaattttttaatgtgttatagtgagttagtaataaagggagataggaaattagatggtttatttttaaattgttggtatttaattatttttttatgtaaatttaatagtagttatagaaaggaaatttaaaaaatatgtattttttattattgtattaaaattaaaaatattaggtttttggaaagataagttttatttgtttttttggggatttagaaagaaagtattaaattatgattttttttgtggagatgagtaatagatataatttttagaagtaagtttgtaaaattatatagaggttttttttataatattattgtttatattatttttggtgatagttaatgcgtatttttgaattatggtttatgaaagtaattttgtagaataaatataattaaatagtttttttattatttgtaatgcgtttggtaattataggttgataaatatatgggttgatttttggatgataaattgaagattgtgatatttaatattttttataaaggttgagtgcggtttttatttatgaagtatcggtggttgttgtttttgttggtattttattttgttttttagtggaggtgatttttaatttatagtatatttaatagaatttttattttgttttgggagtttgttgagttaaatatattagaattttaaaggaaagaagaattttatattaataatatattaggtaaatattaaatatttggggataattgacgtatatatagttagtttttataggttgttattaaagagtagtatatggtttttaaatatttagttttattatataatttattttttgtatgagagaggtaaaatatgtagtttaggataatttgtataatacgtatatataaagtatattataatatttagttttagttttttatttgaagttatggatttttaaatattttagttaatggataatttttagcgaggaagaatatacgattttatttttatttattattggagttttaattattttgatttaatgattgtgggattgtatttttttattgtttagatagattttttattaatatttaataggtaagagatattaaaattttgtttggtttgataggagtagagtttaatgttagttggattgaatttgtttttttaagttttatttttttaaaaatatttttgatttttgttttaattagaattgtttaggaaataaattttgtgttatgtagggggtttaaatatatttttgatttaattatcgtattaatattttatatattatttagttgataataaataatttacgttagatttttattataaatagttagtgtaatcgatggatgaattttataatattgattagtaattatttttatttaggtaaagtttatagtaagagaaaaatgtgtgattaattatcgggatgtatatatttataaaatgttttttttttaggaaaatattttaattt

SEQ ID NO: 135 - DNA, 5834 bp, Artificial Sequence
  chemically treated genomic DNA (Homo sapiens)
ggtgtttgtatatcgaaagttttgttaggaggtttatttttttgtttaagtataaaatttagggtttattaagttaattgagggcgagtaggaggttgaagggtatttggagggttgttcgttttgtgggttttttggtggttgaagagagttgtataggaaggttttgataattgttatagagaaaggagtgtagttgttggttttgtgtgggtgtgtagatgtttgataggtttagttattggttttaattgggatataagtgggattttttttttttttttttttttgagatagttttgttttgttgtttaggttggagtgtagtggtcgcgattttagtttattgtaattttcgttttttaggtttaagtagttttttgttttagtttttcgagtagttgggattataggtgtttacgatttcgttcggttaatttttgtatttttagtagagatggggttttattattttggttaggttggttttgaatttttgattttatgatttattcgtttcggttttataaagtgttgggatttaggtatgagttattgtattcggtttgatataagtaggattttttatatttgtggatgtattgttattggaggagttttgagtttatgtggaagaattttttatttttaggtatagaaagggtttttttttggagtgaagattttggtggtattataggtttggttattatataaaggttttgtttttgtagggttggtatggggtgattggtagttttggagtggagtttgaagtattaatgaaaggtttaattatttggtaggtataggtgcgggggatttgtttggaggggatcggttatgggggttgtgatagtttgtaggttttttttatttttatataagtttgttgtttaagtggattttgtagggtttatgtaggggtagtattagagaagtattttgtgataatggttatataggagcgattttaggaatgagattgaattaggtaaggatttggagaggaagttttagtggggtttttatttaaggggtttaattttattaattttataggtttttagtttggggtttattttatgtttgtaggtttgggattttgtatttaggagagttgttttgttatcggttattttttcgtagaggtttttttttggttttatgttgtttttagtaaagggtttttgttttattttatattttttttgagggtttggggtagtttattgcgaagtagttttagggaatagaggttttagtagggtattttggtttttaatatagaattttggttgtaggatttggaagaatagaggagaaatggaagttggtagtttttaggaggggagaaggtgttggtgagttacgaaagtaaattttagtggttgaagtattttggatgattcggttatatttttttaagaatttttgtgtgtgtgtgtgtgtgagacggagttttattttgttatttaggttggagtgaagtggtgcgattttggtttattgtaatttttatcgtttaggtttaagtgatttttttgttttagtttttcgagtagttgagattataagcgttcgttattacgtttggttaatttttttgtatttttagtagagatggggttttattgtgttagttaagatggtttcgattttttgatttcgtgatgtgttcgtttcggttttttaaagtgttgggattataggtatgagttattatgttcggtttttttttgttttttataaggatatttgttattggatttagggtttattttattaattttagatgtttttattttgggatttttgattaaattatatttgtaaagatttttttttaataggttatattcgttgggtttgggtattagggtatgaatttatttttttgggggttattatttaatttattataggtgggtattttatagaagtagatagtggttaggttaaagtagtttatgaagtattagttatgggtataagattaagtttgggatgcggtagggttaggtttggttttgttaggtaattgggtggattgaatttagtatattttaaacgagttgataattaggttggggattttaatagataattaaggtgttagtaaaggtattaaggagttattacggttaggtgcggtggtttatatttgtaattttagtattttgggaggtcgaggtaggcggattacgaggttaggagatcgagattattttggttaatagtgaaattttatttttattaaaaatataaaaaaaatagtcgggcgtggtggcgggcgtttgtagttttagttattcgggaggttgaggtaggagaatggtatgaatttaggaggcggagtttgtagtgagttaagattgcgttattgtattttagtttgggtaatagagtgagatttcgttataaaaaaaaaaaaggagttattataaggatgtaagattagttaatagtaagattgtggttggtagggtggataggtaaagtgattgtttggagagtgggtaggtggtttagtagggtttagagggtgtttttttagaagtgaggagtttagtttggggtcggttatttaggatggatataatgtattagaagtgaggtagatttttgtagagtttttggggtttttatttagtttgaagaatatagtattagtagttttagatttatgaggttagattttgtattttatcgtagtattttggggatttggggaggttggattattttggatttggtggcgggggtggggggtgtatgagtttcggttttgtagtatttattacgttatatttgagggtatttgttttttgtagtacgatgagttatttttatgaggtttgtaaagatgtttattattaaatgattatggtagttaggttatagggtttatattgacgttgttttattgtatttttatttttatattgaaggggaaaataggtttagaggggtgggtttattgttttgatgagtgttgtttgtttttttttattttttttataattagtatttttatgttttttatttaagattagggagaagtttatttagttttttttgtaattatatagattttagtgggagttttaaggttgttattttgtataggatggagggtaggggtaaaggttattaggcggtggtagtaggtcgtgttttttattagaggttgaggtttgattttttgattagtttagttttagggtatgtgtttttttatgagttgtgattgattatagtttaagggtttattgtggggagtttttagtatatttggatagaaacgttttagaattggggtaagaagagtttttatagttaggtagtgaagaaatatagttgttgggtatttgttatgtgtacgttttagggatgggagtagggggtaggtttagttttgggatttgggttaggtggttgggtttttcggatttcgagttggagggataattttttggaggtagagatgggtattagagatagggcggttttaggtggttttggagtcgtttcgtaaaggttatgtttatgtttgttgtaggtagagatatagttaaagtagttgttatttttggaaagttttagttttgtttatgagtttagatttaagaggttgggataggtagaggggtatgaaggggttatgggtaggtagattgtttatattggttgttagggtggtttaagtgagtagagtgagttggggtatttattatcgtgttaattttacgtacggatgaggatttcgggtcgaaggtttatatttttaattttacgtaatagtttaggtttttgtgagagggttcgttgtttgtttttagttagggttgagttgtttagaggttttatttgtttagaggtagttgggggaagggatagaagttggggggtaggggattgtgtgttggcgggaataattttttttattttatggttaaattttttatttttttttttaatttttggttagaaatttacgtttttgatttttggagaggtcggttagtttaagaggtatttttgagagttacgtttgtagatacgagggtttcgtgacgtgagttttgagggtagggggttgtaatttttcgcgcgggtttttcggtcgtggaggatataaggataaatacgaagggttttcgatttgtcgatttttttttttcggatatcgcgcgtagtttgtaggttattttcgcgttttatttagagacgggtcgcgttgttttcgtcgtcgtaatttcgggttttcgtgtcggcggtttttttttttttacgggcgagattattgtatagtagaggtgaagggcgcggaggttgtgggggaatttagcgtggtatggtaggaaaggtcgagtagggaaataggtttagttagaggttcgggattcggggttcgcgagcgtggtgtttttgggtcgggcggtgggggaggggtcgcgtgtggtaggtatatgcgtacggtaatttggatttgcggagggcggcggtgattattgggttttatttcgttaatttaggttcgtattaggcgcgtgtcggtgaggcggttgtggtcgcggcgaggagttagagggaattgaattggttattttcgcggtaggtgggatttaaggttagtagttgaataaagaagcgagcgttggttagatttttttttttattagatatggttgcgttggttttacggaaatttttgcgtttttgtaggcgtttataagatagggtaattacggggtagcggatattcgttaggtacgtttttagggtcgtttttgtaattgcgtatgcgtttgggttgtatttatttcgtttagtttaaaaggtttttttataattttttttcggattggtttatagggatacgatggttttttacgtaagcgttattcgtgttgattcggaagttttttttttagttaaaagtgttggttcgcggcgcgcggtttttttttgtttgtattagggcggcgcgtggtttacgtcgagtgatagagacgtttaggttgtgtttttaggtgagatcgtcgcggggtcggggattttagggacggtttatggtttttcggggatagtgtttcgcggtttgggtttttttttattaggttttatttttgtttttggaaaagaaaatgtagaagaaacgggcgcgggtcgagttatttttgatttttttttggtgtttcgtcgtttttagtttttttttatagcggggtttggggaatttggtttgaattatgcggttgtattttgagataggaagtttttattttttagggatacgatgtttttttttgttttgtgtaatttttttttcgtaatagtagtttttagagtttttatattgtcggttaagaatcgaaatttttgggttgattgtgttatacggtatttatcgtggtttttgatgttatataacggtttcgttttacggttaaagaaatagttcgagacggaacgttgatttgggttaaagattatgtaaatcgcgagattgtggtttgaattatagtttatgtagtgtgaggacgtatggtatttgttgagttattatattttggttttagtgtagtagttgttgattggtggttgttaagttttgggtttaggggttttaggtgaaagatagatgttttttgttgatagttgagtaatttttttagtgtttgaaaatacgtttacggttttttttggttttttgcgattttttagtttattattagatggcggttagttttagagttgggaatgagtgcgtttttgttttatgttagttgagttttgacgttttttttttgttattattttgttttagg

SEQ ID NO: 136 - DNA, 5834 bp, Artificial Sequence
  chemically treated genomic DNA (Homo sapiens)
tttgggatagggtgatgataggaaaaaaacgttagagtttagttagtatggagtaaaggcgtatttatttttaattttgaggttagtcgttatttagtgatgaattggggggtcgtaaaggattaagaaaggtcgtgaacgtgtttttaagtattagaaaaattatttagttgttagtaagaagtatttgttttttatttagaatttttgggtttaagatttggtagttattagttaatagttgttgtattgggattaaggtataatggtttagtagatgttatacgtttttatattgtatgggttgtaatttaaattataatttcgcgatttatatggtttttgatttaagttaacgtttcgtttcggattgtttttttggtcgtgaggcgggatcgttatatgatattaaggattacggtaggtatcgtgtggtataattaatttaaaggtttcgatttttgatcgatagtatgaaggttttaggggttgttattacggggggaaagttatatagagtaaaagagggtatcgtgtttttaagaaatggaaattttttattttagagtataatcgtatagtttaaattaagttttttaagtttcgttatggggaaaagttagaagcggcggagtattagaaagaagttaagagtaattcggttcgcgttcgttttttttatatttttttttttagagatagaaatgagatttaatgagaaaaggtttaggtcgcggggtattattttcgaaagattatgaatcgtttttaggattttcggtttcgcggcggttttatttgagaatatagtttgagcgtttttgttattcggcgtagattacgcgtcgttttggtatagataggaagaggtcgcgcgtcgcgggttaatatttttaattgggaagaaaattttcgggttagtacgggtgacgtttgcgtaaaaggttatcgtgtttttatagattaattcggaggaaggttgtagaggaattttttgggttagacggaatgggtgtagtttaagcgtatgcgtagttgtagaagcggttttagaagcgtgtttggcggatgttcgttatttcgtagttgttttgttttgtgggcgtttgtaaaagcgtagagattttcgtgagattaacgtagttatgtttaataaagaaaaaagtttggttagcgttcgtttttttgtttagttgttgattttaaattttatttgtcgcgggagtagttagtttagttttttttgatttttcgtcgcggttatagtcgttttatcggtacgcgtttgatgcggatttgggttagcggagtgaggtttagtggttatcgtcgtttttcgtaggtttaggttgtcgtgcgtatgtgtttgttatacgcggttttttttttatcgttcggtttaggagtattacgttcgcgagtttcggatttcgagtttttggttgggtttgtttttttgttcgattttttttgttatattacgttgggtttttttatagttttcgcgttttttatttttgttatgtagtaatttcgttcgtggaagaggggagatcgtcggtacgagggttcggggttgcggcggcgggagtagcgcgattcgtttttgggtggagcgcggaggtagtttataggttacgcgcggtgttcgggaggagggggtcggtaggtcggggatttttcgtgtttgtttttgtgttttttacggtcggggagttcgcgcgaggggttgtagttttttgtttttagggtttacgttacgaggttttcgtgtttgtagacgtggtttttaggggtgttttttgaattggtcgatttttttaagggttagaaacgtaggtttttggttaaaggttgaaaggagggatggaagatttagttatgagatgaaggagattattttcgttagtatataattttttgttttttaatttttgtttttttttttagttgtttttgaataggtagggtttttgaatagtttagttttggttgggagtagatagcgaatttttttataggggtttgaattattgcgtgggattgaggatgtgggttttcgattcggggtttttattcgtgcgtggggttggtacggtagtgagtgttttagtttattttatttatttgggttattttggtagttagtgtggatagtttgtttgtttatgatttttttatatttttttgtttgttttagttttttagatttaggtttatgagtagaattgggattttttagaggtagtaattattttgattgtgtttttgtttgtagtaggtatagatataatttttacgaggcgattttaggattatttggggtcgttttgtttttgatgtttatttttgtttttaaggggttatttttttaattcgggattcgaagggtttagttatttgatttaggttttagggttgggtttgttttttatttttatttttgaggcgtgtatatagtaggtgtttagtagttgtgtttttttattgtttgattgtaaaggttttttttattttaattttggggcgtttttgtttaaatatgttgaggattttttatagtgggtttttggattgtggttagttatagtttatgaaaggatatatgttttgaagttgggttggttaaggggttagattttagtttttggtgaggggtacggtttattgttatcgtttaatggtttttatttttgttttttattttgtgtagagtagtagttttggggtttttattggggtttgtgtggttgtaggaggggttaggtgggtttttttttggttttgagtgaggggtatgggggtgttggttgtagggagggtgggagaaaataggtagtatttattaggatagtgagtttatttttttgaatttgtttttttttttagtgtggaaatgagaatgtaatgaggtaacgttaatgtgaattttgtggtttggttattatggttatttgataatggatatttttatagattttatgagaatgatttatcgtgttgtagagggtaggtgtttttaagtgtggcgtggtgaatattgtagagtcgagatttatgtattttttattttcgttattaggtttagggtggtttagtttttttaggtttttaaggtgttacgataagatgtagagtttgattttatagatttagggttgttggtgttgtgttttttagattggatgaggattttagagattttgtagagatttattttatttttggtatattgtgtttattttgagtggtcggttttagattggattttttatttttgggaaggtattttttgggttttgttgggttatttgtttattttttaggtagttattttgtttgtttattttattagttatagttttattgttagttgattttatatttttgtgatggttttttttttttttttgtgacggagttttattttgttgtttaggttggagtgtagtggcgtaattttggtttattgtaagtttcgttttttgggtttatgttatttttttgttttagtttttcgagtagttgggattataggcgttcgttattacgttcggttattttttttgtatttttagtagagatggggttttattgttagttaggatggtttcgattttttaatttcgtgattcgtttgtttcggttttttaaagtgttgggattataggtgtgagttatcgtatttggtcgtgatagttttttaatgtttttattggtattttggttgtttgttgaagtttttagtttgattattaattcgtttggagtgtgttggatttagtttatttagttgtttggtagagttaagtttggttttgtcgtattttaaatttgattttgtgtttatggttgatattttatgggttattttggtttagttattgtttgtttttatgggatgtttatttgtaatggattgaatggtggtttttaaaaaggtaagtttatgttttaatatttagatttagcgaatgtgatttattggaaaaaaatttttgtagatgtaatttagttaaggattttaagatgagagtatttaggattagtagggtggattttaaatttaatgataagtgtttttataagagatagaagagggtcgggtatggtggtttatgtttgtaattttagtattttgggaggtcgaggcgggtatattacgaggttaggagatcgagattattttggttaatatagtgaaattttatttttattaaaaatataaaaaaattagttaggcgtggtggcgggcgtttgtagttttagttattcgggaggttgaagtaagagaattatttgaatttgggcggtggaggttgtagtgagttaagatcgtattattttattttagtttgggtgatagaatgggatttcgttttatatatatatatatataaagatttttaaggaaatgtggtcgagttatttaggatgttttagttattggggtttgttttcgtggtttattagtattttttttttttttgggaattgttaatttttattttttttttgtttttttagattttataattaggattttgtgttgggggttaagatgttttgttgaagtttttattttttgaggttgtttcgtagtaagttattttaggtttttaggagaggtgtgaaatggagtagaggttttttgttgaagatagtatagagttagagggggatttttgcggagggatggtcggtagtaggataatttttttgggtgtagggttttaggtttatagatatagaatgagttttagattggggatttgtgggattggtaaagttggattttttgggtgggagttttattggagttttttttttaggtttttgtttgatttagttttatttttgaaatcgtttttgtgtaattattgttataagatgtttttttggtgttgtttttgtatgaattttgtagggtttatttagataataggtttgtgtagaagtgaagaaagtttatagattgttatagtttttatagtcggttttttttagataagtttttcgtatttgtgtttgttaagtggttaggttttttattggtgttttaaattttattttagggttgttagttattttatgttagttttgtagggataaggtttttgtgtggtggttaggtttgtggtattattagaatttttattttagagggaggttttttttgtgtttgggagtgggaagtttttttatataggtttaagatttttttagtagtagtgtatttataggtgtgagaaattttatttgtgttaggtcgggtgtagtggtttatgtttgaattttagtattttgtgaggtcgaggcgggtggattatgaggttaggaatttaagattagtttggttaagatggtgaaattttatttttattaaaaatataaaaattagtcgggcgaggtcgtgggtatttataattttagttattcgggaggttgaggtagagaattgtttgaatttgggaggcggaagttgtagtgagttgagatcgcggttattgtattttagtttgggtaatagagtaagattgttttaaaaaagaaaaaaaaaaagaaattttatttgtgttttaattggggttagtggttgaatttgttagatatttgtatatttatatagagttagtagttgtatttttttttttgtgataattgttaaggtttttttgtgtaattttttttagttattaagggatttataaggcgggtagttttttaagtgttttttagttttttgttcgtttttaattagtttggtaagttttgagttttgtatttgggtagggagatagattttttgataaggttttcgatgtgtagatatt

SEQ ID NO: 137 - DNA, 5337 bp, Artificial Sequence
  chemically treated genomic DNA (Homo sapiens)
gagacggggttttattatgttagttaggatggtttcgattttttgattttgtgatttattcgtttcggttttttaaagtgttggggttataggcgtgagttatcgcgttcggttagaattattatattaaaagataagttagattatgttatagttttgtttaaaatttttttggagttttttattttagagtaaaatttaaaggttttattttgtagtttttttatgaattggttatgtgtatttttttttttgtttattattattattattatttattttttttatttttgagatagagttttgttttgttgtttaggttggagtgtagtggtataatttcggtttattgtagtttttgttttttgggtttaagtgggtttaagcgatttttttattttagttttttaagtatttgggattataggcgtttgttattacgttaggttaattttttgtattttagtagagatagggttttattataattgtttaggttcgaatttttgagtttaggtaattcgtttattttagttttttaaagtgttaggattatagatatgagttatcgtgttcggttagttttgtttttttttattgttggatattttattgtatggatataattttattttatttatttatttattaggtgattggtatttgtttttagttaaggataaggttttggttttggtttttgttttatttatttttgtttatgtagtatttttaggtttaagaatagtttttggtatatagtagttaatatattgttgttaaataaatgagtggtttaaattataatttttaaattagggttgagataatttggaaattataattttttttatatgattttttaagtatattttaaataaatatatatacgttaaggttatttttattaatgaaaattgtagtatattatgtatatttttgtattttgtttattggatatgtttaggtttgttttatttttgttaatagttatatggttttgcgttttatggatggggtataattagattttattatatttgtataaaaggaaaggaatttagttttttaagtatgtttagttggtttttggtaatttatgatggaaattaagggttttttttatattattcgtgttttttttagagaggaagggttagagggttttagtttgagtgagagagagagaggaggaagtatgaggggtttgtggaagagggtttggtgttatatgattggattatgtttttgaagaggattagggtgaggttagattttattagttgatttttgagtaatatgggtttgaattgttcgggtttatttttatgtagattgaaaaaagtaaaggttatatagagtatgtttgttttttttgttttgttttttattttttttatttttggtattttgagatagtaagattaaattttttttttttttttgtatttttgtttatttagaatgaagataaggatgaagatttttatgatgatttatttttatttaatgaatagtaaatatatttttttttttttagaatttttttaatattttttttttttttttttttgagacgaagtttcgttttgttatttaagttggagtgtagtggcgcgattttagtttattgtaagtttcgtttttcgggtttacgttatttttttgttttagttttttcggtagttgggattataggcgtttgttattacgttcggttaattttttgtatttttagtagagatggggttttatcgtgttagttaggatggtttcgattttttgatttggtgattcgttcgttttagttttttaaagtgttggggtaataggtatgagttattacgttcggttaatatttttttttttttagtttaatttattataggaatatagaatataatatatatagcgtataaaatatgtgttaattgattatgttattggtaaggtttttagttaattacgagtaatgttttttttaaattttgagatagtgttttgttttgttagttgggttggggtgtaggggtatgattttagttcgttgttgttttaatttttttgatttaagtagtttttttattatagttttttaagtagttggaattacgggtatatattattatatttagttaatttttttgttttttgtagagtttgggttttgtcgtgttgtttaggttggttttgaatttttgggtttaagtgttttgtttattttagttttttaaattttatttggggttataggtgtgagttacggtgtttggtttagtagttaagttttggggaagttaaaagttatatgtagatttttttttttgattttttttttttttttttgaggtagttttgttttgtcgtttaggatggagtgtagtggtgcgatttcggtttattgtaatttttacgttttgggtttaagcgatgtttttgttttaattttttaagtagttgggattataggtatttgttattacgtttgtttaatttttgtatttttagtagagattaggttttgttatgttggttaggttggtttcgaatttttgattttagttgattcgtcggttttggttttttatatagtgttgggattataggcgtgaggtatcgcgtttagtttatatggaggttttcggttgagttgggggttagtgtttttcgtttttagattgtatagagttagttgtgttaagatattaagtatttttagtatataagattttgtgttggttttttttttttttttttttttttttattttaaattattaaattttatgaggaaagttttgttatttttttttatttagtatttttgaagaggttaatttgtttaagattaagagttcgttagtgattgttgaggtttaaacgtagattttttttaagatttgagaatttataggtttaattattattataaaattatttttgtaattacgaggtattcggaatttgtggagtttggattttattttgaagggagtgaaaatttatggaagttttttttttttacgttttttttttttagatgaataatatacgcgtgtttaagatataaaaatgtataaaatttggttaggtatggtggtttatatttgtaattttagtatttggggaggttgaggcgagtggattatttgagtttaggagtttaagattagtttgggtaatatggtaaaatttcgttttaaaataataaaataaataaataaataaaaaatttataaaattgaataaggtagtttgtaagatatggaagtataatgtagatgataataatgacgatggtagttattattaggcgttttatttatgttattttttttaatattggatagatttttatttaatttttataagtttatgaggtaggcgttattattattcgtcgttttatagaggaggacgttgaggtatagagtgattgagaaatttgtcgaaggtattgtagttggtaagtggtgacgtggtatttgaatttaggtattcggatggtgtggatgtcgtggaagagaaaggggcgggtgggattgttttttgaggagatagtgattgtcgaggtagtagcgtagggaagataattgaagaatacgagttgtggagatagattatcgtattcggagtggagagatgggtgtatagatagataataattagattatatataaaaagagaattttaggttaggcgcggtggtttatatttgtaattttagtattttgggaggttgaggcgggtggattatttgaggttaggcgttggagattaggagtttaaaatttcgtttttattaaaaatttaaaaattagtcgggtatggtggtgggcgtttgtagttttagtttttcgggaggttgaggtacgagaatcgattgaattcgggaagcggaggttgtagtgagtcgagatcgtattattgtattttagtttgggtgacgagagcgaaaaatttcgttttaaaaataaaataaattattgataatagtattaatattttttaagtggttattgataataatagtattatgggtgggggggtaatttttttgagagtgttttgtaagtatgtattgaagattgagtaaatatatttaaaatttttagaatagtatgtggtatatagcgttttagaatgttatattattgttagtgatagaaataatttcggttgggcgcggtggtttacgtttgtaattttagtattttgggggggttacggcgggaggttttttcgaggtcgggagtttaagattagtttgggtaatatggtaagacgtcgattgttaaaaaaaaaaaatgttattcgggcgtcgtggcgtgtgtttgtaattttagttattggggaggaggtgggaggatcgttcgagttcgagaggttggtcggggttttagtgagtcgaaattacgttattgtattttagtttgggcgacggagcgagattttgttttagaaagaaaaagaaaaattatcgtttaggggcggagaaggaaggttttttttattttttaggtttttattttttggtcggaaaaaatttagtttttttaggttagtacgtcgttttagtttagttttacgtttttattgttttttagttagttaacgttttttttgattggttttgacgtgcgtggtgcgtgaaaacgttacgagacgtcggcgttattataagagcgtagtcgtggcgtttgcgcgttttttttttagtgatcgggtggtttgtttaggtgaggtgcggcggtgtgttttttttttagggtttgggttggatggtggttcgggtttttcgagtttttatgagtaagttaaagacgttaggaaatagagtagggtggttgaacgggagtgtagtacggttgtgggggtagatattgattatgagagcgttggaggttattttcgcgagatcggatttgggtttcgcgaggttttggcgtagttgtgggattgcgtaggcgtcgtttggagtttttacgtttatatttttttttcgcgtaggcgtagacggggaagcggagttaatatgttagtggttcggagttgggtttgtcgtaaaatttatgtgatttcgcggagatttttcgagaaatttcgtttcgattaagagttgaagttgatcggtgagtggttaaggttttcgggaagtggttcggttttcgggaggcggttagtacgtgaatgaaggtgtttatgtattttatttagttcgttttttaaatttggtattattcgtggtttaggaaggttttgtgattttaaagttgttagtttagttgttgtgttagtaggtgggattatatttgtttatttttttttttttattagg

SEQ ID NO: 138 - DNA, 5337 bp, Artificial Sequence
  chemically treated genomic DNA (Homo sapiens)
tttggtggggagaagggggtggataagtgtagttttatttattggtataataattagattggtagttttggaattataaaatttttttaaattacgaatagtattaaatttaggggacggattagatagagtatatgggtatttttatttacgtgttaatcgtttttcggaagtcgaattatttttcggaagttttggttatttatcgattagttttagtttttggtcgagacgagatttttcgaagggttttcgcggggttatataagttttgcgataaatttagtttcgggttattggtatgttggtttcgttttttcgtttgcgtttgcgcgggagagaagtgtgagcgtaagggttttaaacggcgtttgcgtagttttataattacgttaaaatttcgcggagtttagattcgatttcgcgagaataatttttaacgtttttatagttagtatttgtttttataatcgtgttgtattttcgtttaattattttgttttgttttttaacgtttttagtttatttatggaaattcggaaggttcgggttattatttaatttaaattttagagaaaaagtatatcgtcgtattttatttaagtaaattattcggttattgagaaagaggcgcgtaagcgttacggttgcgtttttatagtaacgtcggcgtttcgtgacgtttttacgtattacgtacgttagagttaattagaagaggcgttggttggttgagaagtagtggagacgtgaggttgggttagagcggcgtgttaatttgggaggattaggtttttttcggttagggagtggaaatttgagaagtagggagaatttttttttttcgtttttggacggtggtttttttttttttttttgagatagggtttcgtttcgtcgtttaggttggagtgtagtggcgtgatttcggtttattgaggtttcgattaatttttcgggttcgagcgatttttttattttttttttagtagttgggattataggtatacgttacgacgttcgggtagtattttttttttttaatagtcggcgttttgttatgttgtttaggttggttttgaattttcggtttcgagagagtttttcgtcgtggtttttttaaagtgttgggattataggcgtgagttatcgcgtttagtcgagattatttttgttattaataataatgtggtattttggaacgttatgtgttatatattgttttaagaattttaaatgtatttatttaatttttaatatatatttatagagtatttttagagaagttgtttttttatttatggtattattattattaatagttatttaaggggtattagtattattattagtaatttattttatttttgagacggagtttttcgttttcgttatttaggttggagtgtagtggtgcgatttcggtttattgtaattttcgtttttcgggtttaatcgattttcgtgttttagtttttcgagaagttgggattataggcgtttattattatgttcggttaatttttaaatttttagtagagacggggttttgaatttttggtttttaacgtttgattttaagtgatttattcgttttagttttttaaagtgttaagattataggtgtgagttatcgcgtttgatttagagttttttttttatatatagtttggttattgtttgtttgtatatttatttttttatttcgaatgcgatggtttgtttttatagttcgtgttttttagttgttttttttacgttgttgtttcggtagttattatttttttaggaagtagttttattcgttttttttttttttacggtatttatattattcggatgtttggatttaaatgttacgttattatttgttagttgtagtgttttcgataagttttttaattattttgtgttttagcgtttttttttgtaaaacggcgaatgatggtagcgtttattttataagtttgtgaggattaagtgagagtttatttagtgttgaggagagtggtataaataaagcgtttagtggtagttattatcgttattattgttatttgtattgtatttttatattttataaattattttgtttagttttatgggttttttgtttgtttgtttgttttgttgttttgagacggggttttgttatattgtttaggttggttttgaatttttgggtttaagtgatttattcgttttagtttttttaagtgttgggattataggtgtaagttattatgtttggttaaattttatgtatttttgtattttgaatacgcgtatattatttatttggaagggggaaacgtggaaggaaaaaatttttataagtttttattttttttaggatgaagtttaagttttataaatttcgggtgtttcgtgattatagagatggttttataatggtggttgaatttgtaggtttttaagttttaaaaaagatttgcgtttgaattttagtagttattgacgagtttttgattttaggtaaattagtttttttaagagtgttaaatgggagaaagtaataggattttttttatagggtttgatgatttagagtaaaaaaaaaaaaaaaagaaaagaaaattagtatagagttttgtgtattgaaggtgtttaatattttaatatagttgattttgtatagtttgggggcgaggggtattgatttttagtttagtcgaaaatttttatataggttgggcgcggtgttttacgtttgtaattttagtattatgtggaaggttaaggtcggcggattaattgaggttaggagttcgagattagtttggttaatatgataaaatttggtttttattaaaaatataaaaattaggtaggcgtggtggtaggtgtttgtaattttagttatttaggaggttgaggtaagagtatcgtttgaatttaggacgtggagattgtagtgagtcgagatcgtattattgtattttattttgggcgatagagtaagattgttttaaaaaaaaaaaaaaaaaattaagaaagaaaatttgtatataatttttgatttttttaaaatttaattattaggttaggtatcgtggtttatatttgtaattttaggtgggatttgggaagttgaggtgggtagagtatttgagtttaggagtttaagattagtttgggtaatacggtaaaatttagattttatagaaaatagaaaaattaattgggtgtggtggtgtgtgttcgtagttttagttatttgggaggttgtggtgggaggattgtttgagttaaggaggttgaggtagtagcgaattaagattatgtttttgtattttagtttagttggtagagtaagatattgttttaggatttaaaaaaaatattattcgtagttgattggaagttttattaataatatagttaattaatatatattttatacgttatatgtattatattttgtatttttatgatgaattaagttagagaaaagaaaatattggtcgggcgtgatggtttatgtttgttattttagtattttgggaggttaaggcgggcggattattaggttaggagatcgagattattttggttaatacggtgaaattttatttttattaaaaatataaaaaattagtcgggcgtggtggtaggcgtttgtagttttagttatcggggaggttgaggtaggagaatggcgtgaattcgggaggcggagtttgtagtgagttaagatcgcgttattgtattttagtttgggtgatagagcgagatttcgttttaaaaaaaaaaaaaaagaaaatattaagaaaattttaaaaaagagaaaatatatttattatttattaagtggaagtggattattataaaggtttttatttttgtttttattttgagtaggtagaggtgtagaaagaagaggagggtttggttttgttgttttagggtgttagaggtggaggaggtaaaaggtaaagtaggagaggtaggtatgttttgtgtaatttttattttttttaatttgtataaaagtggattcgagtagtttagatttatgttgtttaagggttaattgatgagatttggttttattttgattttttttagaagtatggtttagttatatggtattaggtttttttttataaattttttatgttttttttttttttttttttatttaggttggagttttttagttttttttttttgaaaggagtacgggtaatataagaggaatttttggtttttattatgggttgttaaggattagttgggtatgtttggggagttgaatttttttttttttgtataagtgtaataaaatttaattatgttttatttataggacgtaaaattatgtagttgttggtaaaaatgagataagtttgggtatatttaataagtaagatgtagaagtgtgtatagtatgttataatttttattaataaaaatgattttaacgtatgtatatttatttaaaatatgtttagaaagttatgtaggagaaattataatttttaaattgttttagttttgatttaaaaattatagtttaagttatttatttatttagtaataatgtattgattgttgtgtgttaggaattgtttttggatttggggatattgtatgaataagggtaaataaaataaaaattaaaattaaaattttgtttttaattagaaataaatgttaattatttgatgaatggataaataaaatggggttatgtttatataatggaatatttagtagtaaagaggaataaagttggtcgggtacggtgatttatgtttataattttagtattttgggaggttgaggtgggcggattgtttgagtttaggagttcgagtttgggtaattatggtgaaattttgtttttattaaaatataaaaaattagtttgacgtggtggtaggcgtttgtaattttaggtatttgggaggttgaggtgggagaatcgtttgaatttatttgaatttaggaggtagaggttgtagtgggtcgagattgtgttattgtattttagtttgggtaatagagtaagattttgttttaaaaataaaaaaaataaataataataataataataagtaaggaagagaatgtatatggttagtttatgaggaagttgtaaagtaggatttttgagttttattttgagatggaaaattttaggaaagttttagatagagttgtgatatggtttgatttattttttaatatgatgattttggtcgggcgcggtggtttacgtttgtaattttagtattttgggaggtcgaggcgggtggattataaggttaggagatcgagattattttggttaatatggtgaaatttcgtttt

SEQ ID NO: 139 - DNA, 8866 bp, Artificial Sequence
  chemically treated genomic DNA (Homo sapiens)
  unsure (5449, 5462, 5495..5496, 5532..5533, 5552..5553, 5557, 5567)
  unsure (5595, 5601)
gtttgttttggttttttaaagtgtcgagattgtagtttttgttcggtcgttatttcgtttgggaagtgaggagcgtttttgtttgggtgtttatcgtttgggatgtgaggagtttttttgtttggttgtttagtttggaaagtgaggagcgtttttgttcggtcgttattttatttaggaagtgaggagcgtttttgttcggtcgtttatcgtttgagatgtggggagcgtttttgtttcgttgttttttttgggaggtgaggagcgtcgttgttcggtcgtttcgtttgagaagtgaggagttttttcgttcggtagtcgtttcgtttgggaagtgaggagcgttttcgttcggtagttattcgttcgggaaggaggtggggttagttttcgttaggttagtcgtttattcgggagggaggtagggggttagttttcgttcgttagtcgtttcgtttaggagggaggtgggggggttagtttttcgttcgttagtcgttcgttcgggaggtgaggggcgtttttgtttggtcgtttttattgggaagtgaggagtttttttgttcggttattatttcgtttgggaggtgtatttaatagtttattgagaacgggttatgatgataatggcggttttgtggaatagaaaagggggaaaggtagggaaaagattgagaaatcggatggttgttgtgtttgtgtagaaagaagtagatatgggagattttttattttgttttgtattaagaaaaatttttttgttttgggattttgttgatttatgattttatttttaattttgtgttttttgaaatatgtgttgtgtttatttagggttaaatggattaagggcggtgtaagatgtgttttgttaaatagatgtttgaaggtagtatgttcgttaagagttattattattttttaattttaagtatttagggatataaatattgcggagggtcgtagggttttttgtttaggaaaattagagatttttgtttatttgtttatttgttgattttttttttattattgttttatgattttgttaaatgtttttttgtgagaaatatttaagaatgattaattaaaaaaaaaaaaaaaaaagaatagattataggttaggtatggtggtttatatttgtaattttagtattttgggatgttaagttgggtggattattttaggtcgggagttcgagatcggtttggttaagatggcgagatttcgtttttattaatattataaagattagttgggtatggtggtttatgtttataatattttggaggttggggtataagaattatttgaatttgggaggtagaggttgtagtgagttaagattcgtgttattgtattttagtttgggcgatagagtaagattttgttttaaaaaataaaattaaaaaaaaaaaaagattagtattttttagtatagattatttatttatattaaaaatagaatattggtgtggtagagggggaagttggggtttaggaggcggagtttgaggtttgtttattttttgttttgttttaaaaataaaaaaataaataaaatagattaatgtgtaaaatatttaaattttttttttttttttgttttaacgtttttatatttaagtttaaatggtgataatgatttaaaagtgaaattgaaatggtgagagaagtacgattaaaaagggaattttttttttaatatttatttggaaatattaaatgtagaaaatgtagatatattttgaaaattgttgtaaaaggtttatgaattattttttttttttaaattaataatatttttaaaatttaataatagtaatatgttaataattaatattttatattaggaaatattataatatttgaagaaagtagtttttatatttaaataatttgagaatgtaatttaaatttaatagatttttagaggtagaaatttatgtgggtgaatgtgattttaataagaattagtaggaataaaagttttttgtatagtaaaatttttttgatttggattgatatttagtgaaaagaattggttgtttgtttttagagaaagagtgtttagtagaaagtagaatagtttatggaaatagtatatagtattattatttttttatggtaattagattaataaagtttggttttgtattggttttgtttttataggaataaatagtatgtaattagtttattgaatatttgtttgtaagataagtatgtttgtgaattaggatttgaaagtaattggttataaattttaaaattgtttttgtttattattatttgtttagaaatttttttagtataattatagattttgttttgttttgttggtagagatgggggtttggttttgttgtttaggttggttttaaagttttggttttaagatatttttttattttaattttttaaagtgtagagattatcggtatgagttataaaatttgatttagattttgtatttagagttaaaaaaagtttattggaaaaaaaaaagtttattgaggtttattaggaattatatagtataatatgtattgttttttaagtagttatttatgtttggtttaatagtaattttttttttttttgagtcggagttttgtttttttgttttggagatggagttttatttttgttgtttaggttggagtgtaatggcgtaatttcggttttttgtaatttttatttttcgggtttaagtaatttttttgttttagttttttaagtagttgggattataggtgcgtattattacgtttggttaattttttgtatttttagtagagacgggggttttattatggttaggttggttttgaatttttgattttaggtgattcgttcgtttcggttttttagagtgttgggattatagatgtgagttatagcgttcggtttaggagttttgtttttgttgtttaggttgtagtgtaatggtaagattttagtttattataatttttattttttaggtttaagcgatttttttgttttagtttttcgagtagttgggattataggtatgcgttattacgtttagttaattttgtatttttagtagagacggggtttttttatgttggttaggttggtttcgaatttttgattttaggtgattcgttagttttagttttttaaagtgttgggattataggtatgagttattgcgcgcggttttaatagtaatttttatagttttttaatagaagaaagttaatttagtgaggttttatagaatttatattttattttttagatattatataatttttttttttgagatggagttttgttttgtcgtttaggttggagtgtagtggtacgattttagtttattgtaattttcgttttttgggtttaagtagtttttttgttttagttttcggagtagttgggattataggtatacgttattacgttaggttaattttttgtattttagtagggatagggttttattgtgttgtttaggttggttttaaatttttgagtttaggtaattcgttcgtttcggttttttaaagtgttggtattataggcgtgagttattgcgtttggtttttatatagtttttataattattgtttaatttttttgagaagaatttatagatttttataattattgttttttttgagaagaattttgttaagaaaaaaattattaagattaagggagaatatatatattttatagagtttttattttttttttagagatttttttgagagagattaattttttttataatttaattaacgtaaaaaatatgtataaaattatagtatgatttggaaagaatttatgttttatttattaattaggtttgttttttttgtattttttattttatatttatatttattaaatgaagttgtaaaagacgaaaaagataaaaatgtaaatatttaaatgtttttttttatgtatatttttaatttttgtgtattttaagaatttacgatgtaatgtttatgtttttagtaaaaaagaattttttttttatttgtagttggtgtttagagtaattttaatgtaaagaagttttgtatttatttggtattgttgagtggttgagtagtaaggttgttatttttattgagtggagatatataaagatgatttaggagttttagtttttaggatcggagtattggtggattatacgtgttataaagtagaaagtattaggaaaagtaaattagttattttgagttttagatgtaaataatttttaaattgttattggttaaaatgttttaaatatttagggttttgttataattttaatataaaggggggaggggggagcgggattttatagttttatttttttgttttttagattttaagaatttagatcgtggtggtgtaaattggtgattggtttaaaagaagttggagggggcgtgtaggataggaggttttattattagttttagggtgcgttaaggtttatggtgtaaaaattattatttagaatggcggggtttatggattttttattatggttaaattttcgattatttttgatgagttttaaagattagagtagttgattaggttaggttttttagtagaagggcgcgacggttgtaatattagcggttaaattgtatagttttttataggtcggtttaatgtattcgtattaagattgttaaggttgagggtttttagtttggggaaaaacgaaaggaggtagagggtagggagacgggaaagaagataaggagggtgtagaaaacggggagaggagggggcgggatagtatggggaaggttttaggtttattggagagatcgtggcgtttttatagaaacgtattttttcgtttatgattcgcgtgttagtttttttagtttttttcgcgtcgttttttggttgttttcgtttagtttttttgtgtcgcgtagaataacgagatgacgtatgcgtaaagcgtagcggtcgtatatataaacgcgaattcgggttttttttcgtagtgtcgtcgggatttttggcgggtgaaggtgtgtgttagtttttgcgttattcgagttttgggcgttgtttgttaaagagtcgagtacgcgggtttgttattatgtcgcgttacgggcggtacggaggaggtaagaagttggagttcggtgagggacgttggtgtgggtgtagtgagtattgcgaggtcgtagggttgtcgcggaggttgggagacggttatttcgcgtgcgtaatggcggtttaggagtacgttagacgaagtcggaggtagcggaggcggggtgttgaagggagacgggatggcgggtgtatatttttgtcgagtttcgtatttttgggtatttttgtggtttaatttagtttaaagtagggttgagatgacggttttcgcgttgtttttttcgaaaatacgattcgtttttcgggggggcgttcgcggttttnttcgggtgtcggntttcgtttttttcgcgggggttaataatcgcgnnaggcggggggcggggtatcgttttaattttagtttnngagaggttaggggggggannattnaggacgggantagagtttttttttttatcgtaggaaantaaagngtcgttaagattagtttgggtaatatggcgaaattttgtttttataaaaaaatataaaaattagtcggatgtggtggggtatgttcgtgttttagttattttagaggttaaggtgggaggattatttgagtttggggaggttaagtttatagtgatttgtgtgggtgatagagtgagataaagaaaagaaaaagaataagaataagaatataggtcgggtacgtggttcgtcgggattagtggtttacgtttgtaattttagtattttgggaggtcgaggcgggtggattatttgagattaggagttgaggtaaggaatgtggtggtatacgtttgtagttttagttatttgggaaattgaggtataagaatcgtttgaattcgggaagtagaggttgtagtgagttgagatcgcgttatttatattttagtttgagtaatagagtgatattttgttttaaaaaaaaaaaataatttaaattaatatttattagatcgttatgattatttttaatgtatatatattataataaatttaagataaagtaattatttaattgttaatattataaaagttagaaaaatatattagtgaatataaagattgatgtttttgaagtagaaagagtttttatgaattagtaagttagaatatatattttagtagaaaaaaattagtaaaggatataaataaattgttaataagtataatgtttagttttattgtaaattaataaaatataaattaaaaaatataagatttttttttttgttgttgttttaggagtttttttttgttatttaggttggagtgtagtggtatgatttttgtttattgtaaattttgtttttcgggtttaagtgatttttttgttttagttttttgagtagttgggattataggtgcgtgttagtatgtttggttaatatttgtgtttttagtggagacgggattttattatgtttgttaagttggtttcgaatttttgattttgtgatttgtttattttggttttttaaagtgttgggattataggcgtgagttattgagtttggttaaaaagattttttttttttttagatagagttttgttttgtcgtttagattggagtgtagtggtataattttagtttattataagttttgttttttgggtttacgttatttttttgttttagttttttgagtagttgggattataggcgttttttattacgttcggttaatttttgtatttttagtagagatagggttttattacgttagttaggatggtttcgattttttgatttcgtgattcgtttgttttagttttttaaagtgttgggattataggtatgagttattatgtttggtttaaaaatttatttttaaaattaaatttggtagattaaaaaattaatatttagtattaaggaaggtattgagaattaaaattattgtagatttgttgttttttattttagtattatttataatataaaatatgaaagtaatttaaattttttacgagaggatttttaattaatggaatattatgtaaataaaacgttgtagaagaatatttaatgatttagaaaattgtttatggtataatgtattgtattagttggggttttttagggaaataaaattagtaggatatttatatttatattatttatttatttattaagatttagtgtaaggaattggtttatgtaattatagaagtgaaatagtttgagtttgtaaatttattaaaaaataaaatgttaatattataggatttttaaagaaaatagatagttataaatagtgattgggaaggtataaaattgaatgtgatttttaattttttttttttgagatagggttttgttattttttttagaatggagtgtaatgttatgatagtttattgtaatttttgtttttttaggtttaagttatttttttgttttagttatttaagtagtcggggttatagtcgtatgttattatgtttggttaatttttgtatttttagtagagacggggttttattatgttggttagattggttttaattttttgattttagatgatttgtttgtttttgttttttaaagttttggattataggtgtgagttattattcgatcgattcgtttttaaaagtacgtttataaaaaagaatacggtttttttaatgatttcgattttttcgaaaaggtttataatttgattaaataaattgggttttttgtaaagatcgatcgcggtttaatatgtgtttacgtcgtatcgagagtaaaaattgaattcgtaagaattttggttggttaataaaattcgagttttaggttttttaaagttggaaacgttaatcgcgtgttaaggcgttaggataatttagataaaacgagttagcggagcgggtttgaagcgagacggatgcgggttaatattttgcgatttcgtattttgggtattttgtgtttaatttagttaaagtaggttagatgacgttttcgcgttgtttttttcggagttgtcgtcggtttttttttttttttttttcggcgcggttgttattttgcgtatattgaggatcgtggtggcgtatttttttagcgttttttcgttattttagcggatagatttggtcgtagttgtaagatcgtggttgtgtttgagatagaacgaaattggtagttgtgagttgtatgttttcgttaaataatcggttaaattgcggaatgggaatggggacgtaatttgcgattggcggttgggttttttttagttatttttagcgcggtttatggttttggggcggggagttggagttttgggcgagtttgtgtttgggacgtttgtcgcggaggacgagagtcggcgtagttttgtttttttggttcggttttatcgaggttttttcgtcgtcgacgtcgttgtcgttgcgggttcgcgcgttttcggtgcgttcggggttgtcgggatttatgggtggggtcgggttaggtttcgttttacgtttcggtgtattttattacgcgtttttgtttgtgttcgggagggttatttcgtattatttagaacgttaagaattttgttaaaagtttagttttttagggatttgcggatttttattagttttacgattaagttttgttttggatagagggtattaaatgtgttttatttaattttgaggatggttcgttttaaggtaaataagtaattgaaatttgggttagattttgcgtaacgtgtatttttttatttgcgtttttaaataga

SEQ ID NO: 140 - DNA, 8866 bp, Artificial Sequence
  chemically treated genomic DNA (Homo sapiens)
  unsure (3266, 3272, 3300, 3310, 3314..3315, 3334..3335, 3371..3372)
  unsure (3405, 3418)
tttgtttaaaaacgtaaatagaagaatgtacgttacgtaaaatttggtttaagttttaattatttatttgttttaaaacgggttatttttaagattgggtaaagtatatttaatgttttttatttaagataaaatttagtcgtaaaattggtgaaagttcgtaaatttttgagaaattagatttttgataaaatttttaacgttttaaataatgcggggtgattttttcgaatataagtagaaacgcgtggtaggatatatcgaggcgtggggcggaatttggttcggttttatttatgagtttcggtagtttcgggcgtatcgggagcgcgcgggttcgtagcggtagcggcgtcggcggcgggagggtttcggtagggtcgggttaggagagtagggttgcgtcggttttcgtttttcgcggtaaacgttttaggtataggttcgtttaagattttagtttttcgttttagagttataaatcgcgttggaaataattaaaaaaaatttagtcgttagtcgtagattacgtttttatttttatttcgtaatttaatcgattgtttgacgagaatatgtagtttatagttgttaatttcgttttattttaaatataattacgattttatagttgcggttagatttgttcgttgaagtggcgggaaagcgttgaggaaatgcgttattacggtttttaatgtgcgtaaaatggtagtcgcgtcgagggggggggggaggggggtcggcggtagtttcgagaaaggtaacgcgaaaacgttatttaatttgttttagttggattgggtataaaatgtttagagtacggaatcgtagaatgttaattcgtattcgtttcgttttagattcgtttcgttggttcgttttgtttgggttgttttagcgttttagtacgcgattaacgtttttaattttggaaaatttaaggttcgagttttattaattaattaaagtttttacggatttagtttttattttcggtacggcgtaagtatatattaaatcgcggtcggtttttataagaggtttagtttgtttagttaaattgtaaattttttcggaaaagtcggggttattagaggagtcgtgtttttttttatgggcgtgtttttggggacgagtcgatcgaatagtggtttatatttgtaatttaggattttgggaagtagaggtaggtagattatttgaggttaggaggttgagattagtttggttaatatggtgaaatttcgtttttattaaaaatataaaaattaattaggtatggtggtatgcggttgtaatttcgattatttgagtgattaaggtaggagaatggtttaagtttggggaggtagagattatagtgagttattatgatattgtattttattttgggagagatagtaagattttgttttaaaaaaaaaaaattaaaaattatatttagttttatatttttttagttattatttgtgattgtttgttttttttaaaagttttgtagtattgatattttattttttgatagatttgtaaatttaaattattttatttttataattatatgagttaattttttatattaaattttgatagatagatagatgatatagatatagatattttattggttttgtttttttggagaattttaattaatataatgtattgtgttataaataattttttaagttattaaatatttttttataacgttttgtttgtatagtattttattaattaggaattttttcgtaagaagtttagattgtttttatgttttatgttataggtaatgttgaagtgaaaaataataaatttgtaatggttttggtttttagtattttttttaatattggatgttaattttttaatttgttaaatttgattttaaaaatggatttttgggttaggtatggtggtttatgtttgtaattttagtattttgggaggttgaggtaggcggattacgaggttaggagatcgagattattttggttaacgtggtgaaattttgtttttattaaaaatataaaaattagtcgggcgtagtggagggcgtttgtagttttagttatttaggaggttgaggtaggagaatggcgtgaatttaggaggtagaatttgtagtgagttgagattgtgttattgtattttaatttgggcgatagagtaagattttgtttaaaaaaaaaaaggatttttttggttaggtttagtggtttacgtttgtaattttagtattttgggaggttaaggtgggtagattataaggttaggagttcgagattagtttggtaaatatggtgaaatttcgtttttattgaaaatataaatattagttaggtatgttggtacgtatttgtaattttagttgtttaggaggttgagataggagaattatttaaattcggaaggtagagtttgtagtgagtaaagattatgttattgtattttagtttggatgatagagagagatttttgagataataataaaaaaaagaattttatattttttaatttgtattttgttgatttatagtgaggttgaatattatgtttattggtaatttgtttatgttttttgttgatttttttttgttggggtgtatgttttagtttattgatttataggaattttttttattttaaggatattagtttttgtatttattggtatatttttttgatttttgtagtattaatagttaaatgattattttattttaagtttgttatagtatatgtatattgaaaataattataacgatttggtaaatgttaatttaggttgttttttttttttgagatagagtattattttgttgtttagattggagtgtgaatggcgcgattttagtttattgtaatttttgtttttcgggtttaagcgatttttgtgttttagttttttaagtagttgggattataggcgtgtattattatattttttattttaatttttgattttaggtgatttattcgtttcggttttttagaatgttaggattataggcgtgagttattggtttcggcgagttacgtgttcggtttatgtttttgtttttgtttttttttttttttttgttttattttattatttatataggttattgtgggtttgatttttttagatttaggtgatttttttattttagtttttagagtaattgggatacgggtatgttttattatattcggttaatttttgtatttttttgtagagatagggtttcgttatgttgtttaagttggttttagcggtnttttgnttttttgcggtgggggggggggttttgntttcgttttnggtnnttttttttttggttttttnngggttggggttggggcggtgtttcgtttttcgtttnncgcggttgttggttttcgcggggggggcggggntcggtattcgggnggggtcgcgggcgttttttcggggggcgggtcgtattttcgagaaaggtaacgcgaaaatcgttattttaattttgttttaggttggattgggttataaaaatgtttaagagtacggaattcggtagagatgtatattcgttatttcgtttttttttagtatttcgttttcgttgttttcggtttcgtttggcgtgtttttaagtcgttattacgtacgcggaataatcgttttttaattttcgcgataattttacggtttcgtagtgtttattatatttatattaacgttttttatcggattttagttttttatttttttcgtatcgttcgtaacgcgatatgatgatagattcgcgtgttcggttttttagtaagtagcgtttagggttcgagtgacgtaaaagttgatatatatttttattcgttaagagtttcggcggtattacgaggaagagttcgggttcgcgtttatatatgcggtcgttgcgttttgcgtatgcgttatttcgttgttttgcgcggtataaaggagttgggcggaaatagttaagaaacgacgcggaaggaattgaagagattaatacgcgggttatgggcggagggatacgtttttatgggaacgttacgatttttttagtaaatttgaggttttttttatgttgtttcgttttttttttttttcgttttttatattttttttgttttttttttcgtttttttattttttgttttttttcgtttttttttaggttagggatttttagttttaataattttagtacggatgtattagatcggtttatgaaaggttgtataatttaatcgttgatgttgtagtcgtcgcgtttttttgttgggggatttggtttagttagttattttgatttttggggtttattagaggtaatcgaaggtttggttatggtgaaaagtttatgaatttcgttattttgagtagtggtttttatattatagattttgacgtattttgggattggtggtaaagttttttgttttatacgttttttttaattttttttgaattagttattagtttgtattattacggtttgagtttttggagtttgaaagataaaggaatagagttgtggggtttcgttttttttttttttttttatattgaaattgtgataaaattttgaatgtttaaagtattttggttagtgataatttggaaattatttgtatttgaagtttaaagtaattgatttgttttttttaatgttttttgttttgtaatacgtgtgatttattaatatttcgattttgaggattgggatttttaagttatttttgtgtatttttatttagtggaaatagtagttttgttgtttagttatttaatagtattaaataaatgtaaaatttttttatattagaattgttttagatattaattataaatagagaaaaagtttttttttgttagaaatatagatattatatcgtaaatttttggaatatataaaagttggaaatgtatataaaaaaagatatttaggtatttgtatttttatttttttcgttttttgtaattttatttggtgagtataggtgtggaatggagagtatagggaaagtaggtttagttggtgaataaagtatggattttttttaggttatgttatgattttatgtatattttttacgttgattaagttatggagagaattaattttttttaggaagatttttaagaagaaaatagaagttttgtagagtatatgtgtttttttttagttttggtgattttttttttaataaggttttttttaaaagaaataataattataaagatttataggttttttttaaaagaattaaataataattataaagattatataggggttaggcgtagtggtttacgtttgtaatgttagtattttgggaggtcgaggcgggcggattgtttgagtttaggagtttgagattagtttgggtaatatagtaaaattttgtttttattaaaatataaaaaattagtttggcgtggtggcgtgtgtttgtagttttagttatttcggaggttgaggtaggagaattgtttgaatttaggaggcggaggttgtagtgagttgagatcgtgttattgtattttagtttgggcgatagagtaagattttattttaaaaaaaaagattatatggtatttgaaagataaaatataaattttgtaaagttttattaagttgatttttttttgttaagaagttatgaaaattattgttgaggtcgcgcgtagtggtttatgtttgtaattttagtattttgggaggttgaagttggcggattatttgaggttaggagttcgagattagtttgattaatatggaggaatttcgtttttattaaaaatataaaattagttgggcgtggtggcgtatgtttgtaattttagttattcgggaggttgaggtaggagaatcgtttgaatttgagaggtggaggttgtggtgagttgagattttgttattgtattatagtttgagtaataagagtaaaatttttaggtcgggcgttgtgatttatatttgtaattttagtattttgggaggtcgaggcgggcggattatttaaggttagaagtttaagattagtttggttatggtgaaattttcgtttttattaaaaatataaaaaattagttaggcgtggtggtgcgtatttgtaattttagttatttgggaggttgaggtaggagaattgtttgaattcgggaggtggaggttgtagggagtcgagattgcgttattgtattttagtttgggtaataagagtgaaattttatttttaaaataaaagagtaaaatttcgatttaaaaaaaaagaaaattattgttgagttaagtatagataattgtttgaaagatagtgtatgttatattgtataatttttaataaattttaataaatttttttttttttaataaattttttttgattttgaatataaagtttaagttaggttttgtggtttatgtcggtaatttttgtattttgggaggttgaggtgggaggatattttgaggttaggattttgagattagtttgggtaatagaattagatttttatttttattaataaaataaaataaagtttatagttgtattaaagaaatttttaagtaagtaatagtaaatagaagtagttttaaaatttataattaattgtttttaaattttgatttatagatatgtttgttttgtagataggtgtttaataagttaattatatattgtttatttttatgaaagtagggttagtataaggttaggttttgttaatttggttattatgaaaaaataatagtattgtatattatttttatagattattttattttttattgaatattttttttttaagaataggtaattaattttttttattaaatgttagtttaaattagggagattttattgtgtagagaatttttatttttgttgatttttgttgaaattatatttatttatataagtttttgtttttagaaatttgttaaatttagattatatttttagattgtttgaatatgaaaattattttttttaaatattgtaatattttttaatatgaaatattagttattaatatgttattattgttaaattttaaaaatattattagtttaggaaaggggagtaatttataagttttttatagtagtttttaaaatgtatttgtattttttatatttggtatttttagataaatattaaagaaaaagttttttttttaatcgtattttttttattattttagttttatttttaagttattattattatttgagtttggatgtgaaaacgttaaaataagaaaggaaaaaaaatttaaatgttttgtatattagtttattttgtttgtttttttgtttttaaggtagggtaagaagtgggtagattttagatttcgttttttggattttaatttttttttttgttatattaatattttatttttaatataaataagtagtttatgttaaaaaatattagtttttttttttttttaattttattttttgagatagagttttgttttgtcgtttaggttggagtgtagtggtacgaattttggtttattataatttttgttttttaggtttaagtgatttttgtgttttagtttttaaagtattataggtatgagttattatgtttagttaatttttgtaatattagtagagacggggtttcgttattttggttaggtcggtttcgaattttcgatttaaagtgatttatttaatttggtattttaaagtgttgggattataggtgtgagttattatgtttggtttatagtttatttttttttttttttttttttaattgattatttttgggtgttttttatagaggggtatttggtagggttataggataatagtggagggaaggttagtagataaataagtgaataaaggtttttggtttttttaggtagaggattttgcggtttttcgtagtgtttgtgtttttgggtatttgagattagggagtggtgatgatttttaacgagtatgttgtttttaagtatttgtttaataaagtatattttgtatcgtttttaatttatttaattttgagtggatatagtatatgttttagagagtatagggttgggggtaaggttatagattaataggattttaaggtagaagaattttttttagtatagaataaaatgaaaagttttttatgtttatttttttttatatagatatagtaattattcgattttttaattttttttttattttttttttttttttattttataaaatcgttattgttattatggttcgtttttaatgagttgttgggtatattttttagacggggtggtggtcgggtagaggggttttttattttttagtaggggcggttaggtagaggcgttttttatttttcggacgggcggttggcgggcggggggttgatttttttattttttttttggacggggcggttggcgggcgggggttgattttttatttttttttcggatgggcggttggtttggcgggggttgattttatttttttttcggacgggtggttgtcgggcggagacgttttttattttttagacggggcggttgtcgggcggaggggttttttattttttagacggggcggtcgggtagcgacgttttttattttttagaaggggtagcgggatagaggcgttttttatattttagacgatgggcggtcgggtagagacgttttttattttttagatgggatggcggtcgggtagagacgttttttattttttagattgggtagttaggtagaggggttttttatattttagacgatgggtatttaggtagaaacgttttttattttttagacggggtggcggtcgggtagaggttgtaatttcggtattttgggaggttaaggtaggt

SEQ ID NO: 141 - DNA, 7810 bp, Artificial Sequence
  chemically treated genomic DNA (Homo sapiens)
ttttttttttttttataaaaataaaaataatttatgttgaatttttgtattttattttatttttttttatttttattttttttgtaattaatattagtgggttattattaatagattagtaaatggagataaaagaaaagtatttgttttaaattatttattaggttatagaatagagttggttttcgagtttgtaatttttttatttttggtttttgttattagatagttataattaacgaagaagatattttagattatttagtattagttaatttggattttgtatttgtattatttaatggaagaagatgaaataataggtagtttttatttttaattatttgaaatttttatgcgtagataagtatatttttatggtggttttgtttaatttttgttggtagttaagaaggtgaggtgggaggttatgtaaaatttatttaataattatataattatttgttgattaattttttaattgatttttcgatattgatgaagattatgagtttgtggaattataaaatttattatttcgtagtgtttattttttttaaggtttgtattttttgtgtttgtgtaattttgtatttggaataaagaattattattatttgtgtttaatgtcgtatgatatatataattaattttattgataatttttgaaaatttttaagtaggtttgtaaaaatgtgtttttttgtgagtttttttatttgttttagatttatgtataaatggatttcgtttagttttatttgtttttaaacgcgtatttttgaggtttgggaatttaaggataaaatgattttaatttgatgtattttgtattttgattaataagggaaaaataaatgtttttaaatttgattggttttagttatatttgtcggttattatttgttaaattattgtatttaaaattataggtatgaaagattttttaaaaatagatttttgaggaatgtaaattaatagaacggggaggcggattaatgtgtttgattttttaaaagtttatttattgtttaatttattttcgtttttggatatgttagtaagtaattatttttatggttggtaaaatgattgttaaatatttattaataattgtagttttggaattatttttttattaattagttatgttggtttttaaaaattgttatttttggttagatataggagttaggtgttgagagttgatttggtgttaagttttaggattgtttagtttttatattagatttttagttaggttttttgaatatttttatagttagaaaatttatttttttagattcgtagatgttgttttttttttattggttttgtatagaatattattatttttgttacgtttttgtttttatggtaataatagatggaaagtgttgtggaattatttatgtttaggaaaggaggtagttaagaaggaagaaaaggtgggggggcggggtggagagggggtacgatttgggagttcggcggtggaggtttaaggaagggaatttgggtgggggtgcggggagtggtggggattgagaggtttgtgagtttttcggaggtttgttgtgaggaaaaaaaaaataaaaagtacgagtataagagtatttttagtcggtcgattgtaaatgtgggtttttataggaataattcgaagtagtaaaattagaagaaattggacgaaaatgggggggaaaaaagggataaagttcgagttttttgaattttgtgtattgttattcggtggattattttagtttttgattttgtggtggggtggagaaaaggggattttttggtgtttcgaaatgtgacggagtagttttgtagagtttaatatgttaatcggttattttgggaattaggaagattattttatacgttttagagggttatagtcggaaagtttttgagttttattttttttatttcgtttcgtttttttttaaaaaaatatatatataaaaaaatatttttagtaaatattgtaaaaatttttaatttatagtttttttttggaatcgagagagtagtttggtggggtggaggtaggaggttggggagtagggatagaaatgtttgttttcggttttgtcggaattttggttatttttttcgttcggttcgatggcggatggaggttagttaggggaaggcgtttgggtggaggtcgttcgggcgaggtcggggtcgtcggggcggggcggagcgtcggtagttggttgggcggttttcgggtaggaggtttcgcgggggcgaggggtagtttaggagggaggtttcgcgggggcggggagtagagtcggtttcgggggttttgtagggcggtcgtcgttcggttgttttcggggcggggcggtttagttgcggtttcgtagggggagggtcgttcgtgtttgatttcgggcggcggtattttgtcgggcgggtattgttttcgttttgtcggttgttggggtcgcgtatagtgtatcgcgcggttgttttgttttttttttttcgttgcgcggcgttcgagcggttagggcgttttcgcgtttggtttattattatagagcggcgggtggggcgggggcggggcggtggttttagatagtcggttgggcgattagaggaaggaaggagggagggcggcggtgagggtggggtggggagggaatattttgtttgcgtcgggtgtatcgtagatagcgtcgcgcgttagttttttagacggcgcgcggggttagaagcgtcgggcgcgcgtttggggggaggggtacgcgcgcgagacgacggggttaggggggcgttttgaggagttataataggttagacggtacgcgcgtttacgagggggtcgggagtcgcgaagtggcggcggcggcgacgacgtcggcgggttcgcgcgcgcggcgtcgtcgttggtttcgtttttttttttttttttttttcggggggttcgttttttttcgggcgggcggagacggcggcggcgtttgcgggaagttgtgtgttttcgtagtgacgtgggcgggtcgtggattcggtgacgttagagggttgtgtgtagcgatgtgtgtggggttcggagtcgcgtcggttttgtcgaagggagcgggcgagcggcgacggtttcggtggttggtataggtgcggtttcggtttacggcggcgacgcggcgtttgcggcgggaggtttgaggcgtttatttttttaggagttcgacggcggcgataggggcggtggggaattcgtaaagttcgtcgagtttattcgggtatcgaggttcgagtagggggtttggatgcgcgggtttcgggtggggtcggggttagagggggtcgttaggcgggtgttttacggttgattacgtttcgttggttttaggcggtgggcgtcggtagggtagggcgttgtagttgacgggagtcgcggggatttcggagattcggacgttcgttatcgttttttttttttagtttagtagcgtttcgcggggatgttttggtttcgattcggttcgttagttttcggcggcgtagggattcgcgttcggcgtttaaattgttttggtgtttttttcgttttggttcggggttggcgcggggaggtgtagtattaggggcgttgaggtgatattcgagaattttttagggagagggtgcgcgggggggtggatttttatagtttttttcgcggttttcgcgggggggcggtgttgggagggtatttggggttattttaggttcgtcggtgggggtggggggatttttttttttatttttttttatttttttgtatatttatttttaggtttttcgtgttttttgtttttttttttttcgggttagagataggtgggtggttttgagtgggcggaggattttagggttttaggggtttttttattttaggttatgttttttgtttttttttttggtttgtgttgagtaaggtgtgtttttgtggtggacgaaagtttgtacgatggttggtggtattggtttttaattttttgggtttgttttaaggtaaagtgttgagagtttgggaagtaaaaatttttatttattggattttttttggttttttttttaagaaggaagtggaaaaagagttttttttttttttttttttttttatttgtattttttgtgaggtttgtttgttttgtgttttttgtttcggattagttttgttgaaggatggagatttttaggcgtggagtttatagtttttggtttttattaagtaaaatcgttaatttttttttaagagaaagttaatttttgtttgtagttattttagaaaaatagtgtatacggattagttgaattaatttatttaaaattgtaatttagttatatatggtagatatgttaatttttatttgatttttttggatgaaattgttgttttgtttttaaataggagatgaagtaatggattttttttttttttttaaaatggtatagttgagaaagtttcggtattattaattgagatgatttgtttaagagtttttatattttgaattcgaaaggttttttatgttatattattgttcgttttacgtaattttaaattgtttttttatttaaatgaatgtttttttagtaaattggtgttagatttaaagaaattatttaagttttattttggtaaattgaatttagtttaagattaagaaattgatttcggtcgggtgcggtggtttacgtttgtaattttagtattttgggaggttcgggcgggcggattatttgaggttaggagtttaagattagtttgattaatatggtgaaatttcgtttttattaaaaatataaaaaaattagtcgggtgtcgtggtttgtgtttgtagttttagttatttcggagtttgagataggaaaattgtttgaattcgggaggcggaggttgtagtatgtcgagatcgttgtattttagtttgggcgatagagcgagatttcgtaaaaaaaagaaaaaaaaaaaaataaaagaaattggttttaaattggttttttggtttttggagtaaatttaaatgtaatttttttttaattttttttttttttttttagattaattaaaagaagaatgaattataatttttgaagataattgggtaattttttaagtcggaggttgtttttattggtgtgaggatttatatacgtttttagttttttagtatagattagtagattattatttttagaggaaatattttttttgtttttttttttggtttttttggtggtaaagattaaatttggttgtattattttgatttgtgtttgagtttagattttatggtataaggaatggtataaattttttatgtgttttggttaaaataaattagattattgtattgattttggatatttttaattgagaaattggtaattttattttaatatgtatatttgaagaatttaagaaaataaaggtatttttagaggtgtgttttttttttttattattagaggtaaaacgaataattttataggatttgtagtgaaattatattagattataaggagaattaaaattaagtcgtaaaatttattaatttaaggggttttcgttttgaaagtttgagagtaagttacgataggtatttgtatttatttattatttttttttttttaaataagtaattaaatagaaatgttaattttagatttaattatttaatagaagagtgtattatggaaaatttttagataaatttttttttggtttagggtttaattaaaaaattgaatgggatgggagatgatggtagttttttagcgaaaaaaatgataacggatatttatgtaaatggaaaaacgataaataaggtgttaatagttaagaaggaatatttggatgattatggagaagtattagtggaaattgatggagagtatgttaagcgaatttgtatttttgtttttgaaattttgtatttaaattttagtttgaaatatatattggtataattttatttaagtagttagagttcgttgggtggattagtagtattttttgttcggtatttttaagaaagtatgtcgtttattgtatttttgttttttttattattttaggttttttttggtttattgtttatttttttagatagttttatagaatttatttagattgtgttggaaggggaatttattttttgtttttaagttggaggagaaaagagattttgtttgttttaagttttaaattttgtttttcgagaatttatattttagtaaataaatatagtgtgtgatgaattgtatatatattgtttaaggtgtattttagattagttttatattttaaaggtattgggtatatttttatttaatgttttattttgtgggttgattatattaattgatgtataaagattatgtaatgttttattgcggttacgaatttttttttaaaatggtagcgtattttttgttaaaagtttattggtttagttaaaggaaattggtagtgtttttgaagtggagtatgaatgtttaggtaaatgttagggtttatttgtattttagttttatgtttagtttgatgtttcgtgtatttaatgtttggagtgttgtggaatgtttgtattttagacgtttgtgatgtatttttatagattatttgataaaagaatttgttattggggttttgaattagttaaatggtattgttatttttatgtgaattaaaaatatttaggaatatttgaagaaaagaaattgaagataattttagaagaaatgaaggagaagtttagtatgagaagtggaaagagaaattaatttaaggtaagttttttatattaatttttaataatggtaatggtttattttgaaatgaaaattttatgtttagtgtgtaatttaatttgtatgttgaatattgtttatgtaataataataaaatatcgattgatatatttgtattgtagtttttaggttataaagtgttttgtagtatgtttttttatttgattttttaaatattttgtgagagaagtaagattattatttcgttttatagataaagtgaatgaagtttagagagataaaatgatttttttaaaattatgtagttagggagtggaggagttagggttttttttttttttttttttgtgtttttagtagaggttaggttttagtatgttggttaggttggttttgaatttttgatcgcgtgattcgtttattttggttttttaaagggttgggattatatttttgagtttttgtgtttagttagggtttaaattttttattttttttggtatatattttgttttttgattattatatttgttgtttttttaggattcgataatttgcgttttggtgttatttttatttgtaaatggtataatggttataattttcgtgggtttaaaatagtatttttagagatatatttatgatttttgatgtttttatgtttggatatttaggtttgtttaatatttgaaataaatggaaaagatatgtatttgaagaatttgtgatttgaaaggaataataaaaaaaatgatagttagagtaaggaaaagttattttaaattaataaaatattaatataaaaatttgtcgggtttagtggtttatatttgtaattttaatattttggggggttgaagtaggtggattatttgaggttaggagtttgagattagtttggttaatatggtgaaattttatttttattaaaaatataaaaattagacggatgtggtgtcgtatatttgtaattttagttatttaggagttgaggtaggagaatcgtttgaatttcggaggt

SEQ ID NO: 142 - DNA, 7810 bp, Artificial Sequence
  chemically treated genomic DNA (Homo sapiens)
gttttcggggtttaagcgatttttttgttttagtttttgagtagttgggattataagtgtgcgatattatattcgtttaatttttgtatttttagtagagatgggattttattatgttggttaggttggttttaaatttttgattttaggtgatttatttattttagttttttaaagtgttgggattataggtgtgagttattgagttcggtaggtttttatattaatattttattagtttaaaataatttttttttattttagttgttattttttttgttattttttttaaattataaattttttagatatatgttttttttatttgttttaaatattgagtaagtttgaatatttaaatatagaaatattagaaattataggtgtatttttgaaaatgttgttttgagtttacgggaattgtggttattgtattatttgtaaatggagataatattaaagcgtaaattatcgagttttagaaaaataatagatgtagtggttaagaagtaagatgtgtgttaaagaggataagaaatttaagttttggttggatataggggtttaaggatgtaattttagttttttgggaggttaaggtgggcggattacgcggttaggagtttaagattagtttggttaatatgttgaaatttggtttttattaaaagtataaaaaaaaaaaaaaaagaagttttaatttttttattttttggttatataattttgggaaagttattttatttttttgagttttatttattttatttgtaaaacggaataatagttttattttttttataggatgtttggaaagttaaatgaggaaatatattgtaaagtattttatggtttaaaaattgtaatataaatatattaatcggtattttgttgttgttgtatgagtaatgtttaatatataggttaagttatatattaaatatagaatttttattttaaagtaaattattattattattaaaaattgatataaaaaatttgttttggattgatttttttttttattttttatgttaaattttttttttattttttttaaaattatttttagttttttttttttaggtgtttttaagtatttttggtttatatgaagatagtaatgttatttagttgatttaaagttttagtggtaagtttttttgttaggtgatttgtgagaatgtattataaacgtttggggtgtaaatattttataatattttagatattgaatatacggagtattaggttgaatataaaattggggtgtaaataaattttgatatttgtttaggtatttatgttttattttaaaggtattgttagttttttttaattgggttaatgagtttttagtaggaagtacgttattattttgaggaaaagttcgtggtcgtaataaagtattatataatttttgtgtattagttaatgtaattagtttataggatggggtattgaatggaagtatgtttagtatttttaagatatgaagttggtttgaagtatattttgaataatatatgtatagtttattatatattgtatttatttgttggagtgtaaattttcggagaatagaatttaagatttggggtaaatagagtttttttttttttttaatttgaaaataagaaatagattttttttttaatatagtttgagtgagttttgtggagttatttgaagggatgagtaatgggttaggaagaatttgaggtgatggaagaggtagaaatatagtaggcgatatgtttttttgggaatgtcgagtagaaaatgttgttggtttatttagcgagttttgattatttaaatggaattgtgttaatgtgtgttttaaattgggatttaaatgtaaagttttaggaatagaagtataggttcgtttaatatgttttttattagtttttattggtgtttttttatagttatttaagtgtttttttttaattgttggtattttgtttatcgtttttttatttgtatgaatgttcgttattatttttttcgttggggggttgttattattttttattttatttagttttttagttgagttttgaattaaggagaaatttgtttggaggttttttatggtatatttttttgttaaataattaagtttgagattagtatttttatttagttgtttatttgaaaagaggaaagtaatgaatggatataaatgtttatcgtaatttatttttaaatttttaaagcgagagttttttaaattaataaattttgcgatttagttttggttttttttataatttggtataattttattataaattttataaaattgttcgttttgtttttaataataaagaaaagaggtatatttttgaggatgtttttgtttttttgaattttttagatatatatattaaaataaagttattaattttttaattaaagatgtttagggttaatgtaatggtttggtttgttttaattaaaatatatgaaaagtttatgttattttttgtgttataaaatttagatttaaatataagttaaaatgatgtaattaaatttaatttttattattaaggaaattaaaaaggagggtagagggagtattttttttaaaaatgatggtttgttggtttgtgttgaaaaattgaagacgtgtgtaaatttttatattagtaagaatagttttcgatttaaaaaattgtttagttatttttaaggattatagtttattttttttttaattaatttggaagaagagaaggggggttggggaagagttatatttgaatttgttttagaggttaaagggttaatttgaaattagttttttttattttttttttttttttttttttacggagtttcgttttgtcgtttaggttgaagtgtagcgatttcggtatattgtaattttcgtttttcgggtttaagtaatttttttgttttagatttcggagtagttgggattataggtataagttacgatattcggttaatttttttgtatttttagtagaaacggggttttattatattagttaggttggttttgaatttttgattttaggtgattcgttcgttcgggttttttaaagtgttggaattataggcgtgagttatcgtattcggtcgaaattagttttttaattttaaattgagtttagtttattaaggtgaagtttgagtgatttttttaaatttaatattagtttattagaagaatatttatttaaataggaaagtaatttggagttgcgtaaagcgagtaataatataatataaaaggtttttcgagtttagaatatgaagatttttaagtagattattttaattagtagtatcggggtttttttagttatgttattttaagggagggaaaaaaatttattattttattttttatttaaaaataaaataatagttttatttaaaaaaattagataggagttaatatatttattatatgtaattaagttataattttaagtggattaatttagttagttcgtgtatattatttttttggaatgattgtaggtaaaaattaatttttttttaaaaaaaggttagcgattttatttaatggaagttaaaagttatagattttacgtttgggaatttttattttttaataagattaattcgggataaaaagtataaggtagataaattttataaagaatgtaaatggaggaagagggaaaaagaaaagattttttttttattttttttttgagagaaaagttaaaagaaatttaataaatagaaatttttgttttttaaatttttagtattttattttaaaatagatttaaaggattaaggattaatgttattaattatcgtatagattttcgtttattataggaatatattttatttaatataggttaaggaagagagtaagaggtatgatttagaatgggggagtttttaaaattttgaagtttttcgtttatttaaagttatttatttatttttaattcggagagagggagaataagggatacgggaagtttgggggtgggtgtgtaagggggtggagggaagtaaagggaggagtttttttatttttatcggcgagtttgggataattttaagtgtttttttaatatcgttttttcgcgggggtcgcgggaaggattgtggaaatttattttttcgcgtattttttttttgggaagttttcgggtgttattttagcgtttttaatgttgtattttttcgcgttagtttcgggttagaacgaagaggatattagggtagtttaggcgtcgggcgcggatttttgcgtcgtcgggggttgacggatcgggtcgagattagggtattttcgcggagcgttgttggattgggggaggggggcggtgacgggcgttcgggttttcggggttttcgcggttttcgttaattatagcgttttgttttgtcggcgtttatcgtttggggttaacgaagcgtgattagtcgtggaatattcgtttagcgattttttttggtttcgattttattcgggattcgcgtatttaaattttttattcgggtttcggtgttcgggtaagttcgacgagttttgcgaattttttatcgtttttgtcgtcgtcgtcgggtttttaggagggtgagcgttttaggtttttcgtcgtaaacgtcgcgtcgtcgtcgtaaatcggagtcgtatttgtgttagttatcgaagtcgtcgtcgttcgttcgtttttttcggtagagtcggcgcggtttcgaattttatatatatcgttatatatagttttttgacgttatcgagtttacggttcgtttacgttattgcggagatatatagtttttcgtagacgtcgtcgtcgttttcgttcgttcgggggagagcgagtttttcggggagggggaggggaagggaacggagttagcggcggcgtcgcgcgcgcgggttcgtcggcgtcgtcgtcgtcgtcgttatttcgcggttttcggttttttcgtggacgcgcgtgtcgtttggtttattgtggttttttagagcgtttttttggtttcgtcgtttcgcgcgcgtgtttttttttttaggcgcgcgttcggcgtttttggtttcgcgcgtcgtttgggaagttggcgcgcggcgttgtttgcggtgtattcggcgtagataggatgttttttttttattttatttttatcgtcgtttttttttttttttttttttagtcgtttagtcggttgtttggggttatcgtttcgttttcgttttattcgtcgttttgtggtgatgggttagacgcgggggcgttttggtcgttcggacgtcgcgtagcggggaagagggggtagggtagtcgcgcggtgtattgtgcgcgattttagtagtcggtagggcggaggtagtgttcgttcggtagagtgtcgtcgttcgaggttaggtacgggcgattttttttttgcggggtcgtagttgggtcgtttcgtttcggaggtagtcgggcggcggtcgttttgtagggttttcggggtcggttttgtttttcgttttcgcgggattttttttttgggttgtttttcgttttcgcggggttttttgttcgagggtcgtttagttagttgtcggcgtttcgtttcgtttcggcggtttcggtttcgttcgggcggtttttatttagacgtttttttttggttgatttttattcgttatcgggtcgggcgggaggggtggttaaagtttcggtaaaatcgagagtaaatatttttgtttttattttttagttttttgtttttattttattaggttgttttttcggttttagaagggagttataaattaaaggtttttatagtgtttattgagggtgtttttttgtgtgtgtgtttttttggagagggacgagacgaggtagggaagataggatttaagagtttttcggttgtgattttttgaggcgtgtagggtggtttttttggtttttagggtagtcgattagtatattgaattttgtagagttgtttcgttatatttcgaaatattaagaaatttttttttttttattttattataagattaggaattgaaatagtttatcgagtagtagtgtataaaatttaggagattcgagttttgtttttttttttttttttattttcgtttaattttttttagttttattgtttcgggttgtttttgtgggggtttatatttgtagtcggtcggttggaaatatttttgtgttcgtattttttattttttttttttttataataggttttcgaaaggtttataagttttttaatttttattatttttcgtatttttatttaagtttttttttttaggtttttatcgtcgagtttttaggtcgtgttttttttttatttcgtttttttattttttttttttttttgattgtttttttttttgaatatgaataattttatagtattttttatttgttattgttatagagatagaagcgtggtaaagataatgatgttttgtgtagagttagtgggggaaaaatagtatttgcgagtttagggggatagattttttaattgtgagaatatttagaaggtttagttgaagatttgatgtgaagattggatagttttgaaatttggtattaggttaatttttagtatttggtttttgtgtttagttagaagtaataatttttagaaattaatatgattggttaataaaaaagtaattttaaaattgtaattattaataaatgtttagtagttattttattagttataagaataattatttgttagtatgtttaaggacgaagataaattggatagtaaatagatttttgagaaattaaatatattaattcgttttttcgttttgttgatttgtattttttagaaatttgtttttgagagattttttatgtttgtgattttaagtgtaatggtttgataaatagtgatcggtaaatatgattagaattaattaaatttgagggtatttattttttttttattggttaaagtataaaatgtattaaattaaaattattttgtttttgaatttttaaattttaaaggtacgcgtttgaaagtaagtgaaattgaacggggtttatttatatatagatttgaggtagatggggaggtttataggaaggtatatttttgtaggtttatttaaggatttttagaagttattagtaaaattgattgtatgtattatacgatattgaatataaatgataatggttttttattttaaatatagaattgtatagatatagaaaatgtaggttttagaaaaaataagtattgcgaggtaatgaattttgtaattttataggtttatggtttttattagtgtcgaaaagttaattaaaggattggttaataaatagttatgtagttattaggtggattttgtatgattttttattttatttttttggttgttagtaggagttgagtaagattattatgagagtgtgtttgtttgcgtatgagaattttaaatgattgggggtggggattatttattgttttatttttttttattaaatagtatagatataagatttaaattaattggtattaggtagtttagaatgtttttttcgttaattatggttgtttgataatagagattaagaatggagaggttataaattcgaaggttagttttgttttgtgatttgataaatagtttgaggtaaatgttttttttttgtttttatttattgatttgttgataatgatttattaatattaattataaagaagatggaaatgagaaaggatagggtaagatgtaaaaatttaatataaattatttttatttttatgaaggagggggaag

SEQ ID NO: 143 - DNA, 8801 bp, Artificial Sequence
  chemically treated genomic DNA (Homo sapiens)
gagtttttgataagtgagtaggaggcggcgggtggttgttttaaattttgatttatgaaaaaaaattagaatttatcgatatattttgttattcgttgagcgtttaagtttttaattaaagaaggtatagtggtagggagtggtaggggggtcgggagaggaggaagggggagaagaaagaagattgattatttttacgattttttatttcgtttcgcgggcgtagggaggtttagcgatgttatttggcggttgtttttttttagattgggagtcggttggttgtagataaatttaggtttttttcgggtgtcgtgtttttgtttttagaatagaagtagaagtttgtatttatgtttgtaatttaagtggttttgtaaatattcgttttttgtttgtttttttgagaaaatcgaaggaaaggaataatgagttggtattggtatgaatagtttaagtttattgtgtgttagttattggttatgagaggaaaatggtataattgttagaaatgtaggttttttaatttttagtttattttagtgataaaaataaatgttaggttttatttattttagaattttattttgatattttgtaaatatgagttatttttatatattattttttaatgtacgtatttttatttttattacgcgttgagtttagttataatgtaatgttattagtttaaaaggatgaagtgtaagttatgtttgtttatttgattgagaagtaaattagttttatatggaggttttttttttataaagtgtggaattaaaaaaattggcgttttttagttgataaaggttaatgatattagattttttagggttttttttttgttaggtaaagtaataattatatagtttttttttttttttattttatttgaattgaatatttgttaggtttgattagcgtttataattatagtttttataattaaggtaaggtaaaattttgtaaattagtgtaaatttagatttgttaaattaatttttatttaggtttttttttttatgttaaaggaatatattaagtagtggaatagaattttattttatttatgttttatattattgtatggatgtgagattttatgttgtgtagatgtgtgagagtagaagaaatgtattagtagatattatatttatattttaaatggaattttattatttaagggaataaaataaaatatttaatttaaaattggaaatgtttaatattattgttaataaagatagtttattattttaaattaggattttttttttttgtaaaattattttggtttttttttaatatagttaaaagattagtattaagaattattttatgtattgtaaagttagtagagggaatattgcgtattgatttagtaggggttattaaatatttggtatttggggaaaaaaatgttagtaatggagaattgattatagagtatatgaagttagggaatgagaagggagaaatttttttttattatttggtattgagaggtttaatatattttagtgtgtatatatttagttggttataaagatgattttaataaaagggtattcgttatatgtttttttatattttaagagaattaatttattagaatagatttattttagaagtttaggtatttgtgtaatatataaatatatatgtagtaattataaagttaatggaagttattgatattatattttattaagtttaagaggaaatttttttttttattttaattttttttgaaataaggaggtattttatatttagggggatattatagttttattggtagtttttttttttggtggaatgtaatataatggtgtgttttaaaatttgttggatttgttgaaatatagaaaatatatgtaataaaagaatgaggttagtggttgtgttttagtatattttttaaaaaatttatgtgttttaagtagaaatatatatgattgttttaatttttatttttttttattatattcgatgatggaagtataaatgattgagaaatataattaataatgttgatatttaatttgattgaattattaaattagttatatttttaaattattagttagtataaatttaaaaataaatatttttttttattttagtgaaaatattgattttatagataatagtttttttaaaataatttttttttgttagattggtaatatttaaggatgtgtttttatgtatattagagaaaatgtagtatataatatagtaatattgttatgtaaaaaaggtgtttgtgtgtttttggtttgggtttttttttttttaaggatttgtttttttttttttaaaaaaattatgtaatataagtagttaatcgttaaaaattatttgtttttatttataaaaatagttttgtttgtggttgatttttatagatttagttagatggttatatagggtgttttttttagtaaaattttaagtttgataatttgggtttattgttagtttatatattttaaaagtttgataagatatatagaaatttattatttagtattagtttaatttgaattaaaagtcgatttaattattttggattgattttatttaattatttatggttagtttgaagaatattagttttttattatagtgttaaggaaagttgatttttattataattttaatttttagatattggaaaataagtaatttttgtagttaacgtttattttgaatattttggtattttttttttgttatattttttttagtattttttatggagttttttttttttaaaattaatggaatggtagggttgttattattgtttttttatggtttatattaatgatttgtgattattttttttttttttttgagatagttatacgttattatttatattggagtgtagtggtttaattttagtttattgtaattttttgggtttaagtaattttttcgttttagtttttcgagtagttggaattataggcgtatgtatttttgtttagttaattttttaattttttaatttttagtagagatagggttttattatgttgattaggttggtttcgaatttttgatttgaagtgatttatttattttagttttttaaagtgttgggattataggcgtgagttatcgcgttttgtttgttattatttttttatataagtggttattttgttttagttttttgaataatatgtagtttttattaggagtgtgtttggtatttgaattagaaaggaagatattagtatttattgagggtttataatatattaggtgttttatagttataaatttattgaatttttataataattttttataaagtagtttttagtgtttttatataatagatgaggaaaattgagatttggttatatttttatagttataaattattaagaaggattagtagttaggtttattatgaattcggaggttttatttttttttgttattagttattatttttttttatagtttttttttgttttggttttttagtttttttcgatttaagtaataagaggaaatatataagaaggaaaggaggaagatggttttgggaggaggagagggaagagagtgaagtaatttttaattttgaaaatagggaaaataaatatttagaaagtaaaatcgatttttattttttatatgttattatatattttatataaaattttggaaatttgtttattgaggtaattacggagtattatttaatgtgttttaagggaaagtttttttgtttgggttatgtaggatttatagggagtttaaattattaaataattatagttgatttttgtttggttaagagagtaagtaattattgtaaagtttttttttttgttttttataaatagtataaaaacggttttgaagggatttatataatatattaatatttgtgttgtatttagagttgttaaaataattgtgatgataggtgtttaggtattatttttttaatggtttttaatatttattgatttattgttttgtggttttttttttttttttatagttttggttttaagaaagagttggggaatagattttgtattagaggttgattttttattttaatgttgaaaagaattaataaaaataattatttggtttttaagtagaaagtttttatttatagtattttatttttatttcgtttcgttttaagttttttgttatttaatataatggttagaatatattttcgtttttttttttaataattttatgtattaatattttttttatatattatatatatacgtacgcgcgtatatatacgcgcgcgtatatatatagtaaaaggaaaaaagaggtagtagaaattttagttgtatttttagtttttttaaaaagtttgttttgtaaattggaatgaggttagatttggagttttttattgtacgcggagattattattgtatcgggttttaagttaatgggaagttcgggggaggggtttggtatgaggaagcgttggttatagtagttgattggttgtagttaagattgtgaaaggataaagaggcgcgaggcggaattggggtttgttttaagttgtagtaagagaaattgtgtgtgaggggaagaggtttgtttcgttgtcgggtttttagtttttgtacgttttttaagagtttgtattggaggaatttttgttattattagttttttttttgtagaagggagggggaaatatatatttatttatgttagtttgttgtatgtaggttttttggttttttattttgtaataaaataattgtattaattttttagtgtcgatttcgtttatagagagttttggagttatagttttttttgttttgtattgtaggagagggattaagtgttagagattatgtcgtttttttgagttatcgagagcgttcgtgaattggaattaattgttttagggaaaaagaaaaaaaaaaaaaaaagatttgtttgggaggtcgcgagaaatttgtattggaagttttagtaattagtattcgagaaatttttttttattttagtacggtttttagatttagtcgagagatagtaaattgtagcgcggtgagagagcgagagagagggagagagagattttttagtttgggaattataatttttttgcgagaggcggagaattttttttttaaattttttggggatttttttttttttatttattttcgtttttgcgaggagttgaggggttagttcggtcgtcgcgcgcgttttttcgttcggcgtgtgtttggttcggggaatcgggagggttcggcgatcgcgcggcggtcgtcgcgagggtgtgagcgcgcgtgggcgttcgtcgagtcgaggttatggtgtagtaaattaataatgtcgagaatacggaagcgttgttggtcggcgagagttcggattcgggcgtcggtttcgagttgggaatcgtttttttttttacgttcggttttatcgtttttacgggcggtaaggtcgacgattcgagttggtgtaagatttcgagtgggtatattaagcgatttatgaacgtttttatggtgtggtcgtagatcgagcggcgtaagattatggagtagtcgttcgatatgtataacgtcgagatttttaagcggttgggtaaacgttggaagttgtttaaagatagcgataagattttttttattcgagaggcggagcggttgcgttttaagtatatggttgattatttcgattataagtatcggtttaggaagaaggtgaagttcggtaacgttaattttagtttttcggtcgtcgttttttttaagtcgggggagaagggagataaggtcggtggtagtggcgggggcggttatgggggcggcggcggcggcgggagtagtaacgcggggggaggaggcggcggtgcgagtggcggcggcgttaattttaaatcggcgtagaaaaagagttgcggttttaaagtggcgggcggcgcgggcggtggggttagtaaatcgtacgttaagtttattttggtaggcggcggcggcggcgggaaagtagcggttgtcgtcgtcgtttttttcgtcgtcgaataggcgggggtcgtcgttttgttgtttttgggcgtcgtcgtcgattattattcgttgtataaggcgcggatttttagcgtttcggttttcgttttttcggtagtttcggttttcgtagcgttcgcggtttcgggtaagtatttggcggagaagaaggtgaagcgcgtttatttgttcggcggtttgggtacgtcgtcgtcgttcgtgggcggcgtgggcgcgggagtcgattttagcgattttttgggtttgtacgaggaggagggcgcgggttgttcgttcgacgcgtttagtttgagcggtcgtagtagcgtcgtttcgtttttcgtcgtcggtcgttcgttcgtcgattatcgcggttacgttagtttgcgcgtcgtttcgttcgtttcgtttagcgcgttttcgtacgcgtttttttcggtttcgttttattttttttttttttttttttcgggtttttcgtttttcgacgacgagttcgaagacgatttgttcgatttgaattttagtttaaattttgagagtatgtttttgggtagttttagttcgtcgtcggcgttcgatcgggatttggattttaatttcgagttcggtttcggttcgtatttcgagttttcggattattgtacgttcgaggtgagcgagatgatttcgggagattggttcgagtttagtatttttaatttggtttttatttattgaagggcgcgtaggtagggagaagggtcggggggggtaggagaggagaaaaaaaaagtgaaaaaaagaaacgaaaaggatagacgaagagtttaaagagaaaagggaaaaaagaaagaaaaagtaagtagggttggtttcgttcgcgttttcgtcgtcggattaaggagcgcggcggcgttttggattcgcgtttttattttttattttttcgggtcggggatttattttgtttagtcggagggacgcggaggaggaagagggtagataggggcgatttgtgattgttgttattgatgttgttgttgatggtaaaaaaaaaaaagcgatttcgagtttgtttttttttgtttgaagagatttttttttttttttaacgagttttcggatttgtttgtatttttagtaagaaggcgagttagttttttagagatttgaaggagtttttttttttttgtattattattttggttttgttttattttgttttttggttaagaaaggaggggagaatttagcgtatttttttttttttttttttaaacgcgtgatgaagatagaaggtttcggggtgacgaatttggtcgatggtagatgttttgggggaacgtcgggattgagagattttacgtaggcgaattttcgtttggggtttttttttttttttttttttttttttgttttttttgtagtcggaggaggagatgttgaggggaggaggttagttagtgtgatcggcgttaggaaatgattcgagaatttcgttggaagcgtagtagcgggagttaggggcgggggcggaggaggatacgaattggaagggggtttacggttaaattgaaatggatttgtacgttggggagttggcggcggcggttgttgggttttcgtttttttttttacgtgaaattagtgaggtgagattttttagatttcggaggcgtggaggagaggagattgtttgatgtggtataggggtagttagtggagggcgagtggtttcggaaaaaaaaaaagaaaaaaagaaaaaaaaagaaaaaaaaaagatttttttttttttttaatcggaatcgtgatggtgttggattattttaatggtggggttaatatagtatgttattttgtttattttttaaagatttttgtataagattgttgagtagtttttaaaatagtgtaggataatataaaaagtagatagatggcgttatgtttgatttttataacgaaattattattagtttttttttatttttaattttttaaaggatttaaacgtaatttaaatttgtgttggattttaaaaaaataatttaggattaaatttttttttagtgtgtgtgtttattttttataggtgtaaatgagaagacgtgttttttttttttatcgatgttttattttcgtatttttttttttttgtaaatgtaattagatgttattttatatgtggacgtatttatattggttaaatatatttttttttttgttttttttttttttttttttttttttattttttttatttttttattttttttttttttttttttttttttttttttttttttttttttttttttttggtagttgttgttatttacgttattttacgttttttttattgaagggttagagttttaatttttaattttttatatttaaatgtagatttttgatatttttaaaaaataaaaaaagataagagagatgaaaacgtttgattatttttttagtgtatttttgtaaaaaatatataaagggggtgttaatcggtgtaaatcgttgtttggattttttgattttataatagggcggttggttaatattttatatagtttaaaaaattagtttttaatttttttatgtttatattttaatttgtaggttttttaaagtgatagtattttttaatttgttattagtgtttatttttcggttttcgttttgtaaaaaggggaggagaattagttaaatattgtaagtttttaagaaaaataaagttttaaacgaaatattgttttg

SEQ ID NO: 144 - DNA, 8801 bp, Artificial Sequence
  chemically treated genomic DNA (Homo sapiens)
tagagtagtatttcgtttaaaattttgttttttttaaaagtttatagtgtttggttaattttttttttttttttataagacgggggtcggagggtggatattggtggtaggttaagggatattgttattttaagaagtttgtagattgaagtgtaaatatggagaaattaggggttgattttttaaattgtgtgagatattaattagtcgttttgttataaaattaggaaatttaaatagcgatttatatcgattaatattttttttatatattttttataaaaatatattgagaaaataattaaacgtttttattttttttgtttttttttgttttttaaaagtgttaaaagtttatatttaaatataaaaaattaaaagttaaaattttagttttttagtgaaggagacgtaaaatggcgtgggtaataataattattaaaaaaaaaaaaaaaaaaagaaaaaaaaaagaaaaaaaggaaaaggaaggaataaagaaataaaggaagtaaaaagaaaggaaagaaaaaaagggataaaagaaaaaatatgtttggttagtataaatacgtttatatataaaatggtatttgattatatttataaggaaaaagaaatacgaggatggagtatcggtgaaggaaaaaaatacgtttttttatttatatttataaggaataaatatatatattgagaaaaaatttggttttgaattgtttttttaaagtttagtatagatttgagttgcgtttgaattttttaaagagttaagaatgaaaaaaagttggtgataatttcgttgtaggaattaaatatagcgttatttatttgttttttatattattttatattattttaaaaattgtttaatagttttatatagaaatttttaaaagatagataggataatatgttatattaattttattattgaaataatttaatattattacgatttcgattaagagaagaaaaaaatttttttttttttttttttttttttttttttttttttttttttcgaaattattcgttttttattgattgtttttgtattatattaaatagtttttttttttttacgttttcggggtttgggaagttttattttattgattttacgtagaaaagaaggcggaggtttagtagtcgtcgtcgttagttttttaacgtgtaaatttattttagtttgatcgtgaatttttttttagttcgtgttttttttcgttttcgtttttagttttcgttgttgcgtttttaacggggttttcgggttattttttagcgtcggttatattggttggttttttttttttaatattttttttttcggttgtagagggggtaaggggaaaagagggaggaaaaaaaagttttaaacgggaattcgtttgcgtggagttttttagtttcggcgtttttttaaaatatttgttatcggttaaattcgttatttcggagttttttgtttttattacgcgtttaaaaaaagggggggaggggtgcgttgggtttttttttttttttttgattaagaagtaaaataaaataaaattaaggtggtgatgtaggaagggggagatttttttaagtttttagaaaattaattcgtttttttgttgggggtgtagataagttcggaagttcgttggaagggggagggggtttttttaagtaaaggggagtaaattcgaagtcgtttttttttttttgttattaataataatattaataataataattataggtcgtttttgtttattttttttttttttcgcgttttttcggttgggtagagtgggttttcggttcgggaaggtgggggatgggagcgcgggtttaaaacgtcgtcgcgttttttgattcgacgacgagaacgcgggcgaagttagttttgtttattttttttttttttttttttttttttttttaaatttttcgtttgtttttttcgttttttttttttattttttttttttttttttttatttttttcggtttttttttttgtttgcgcgttttttagtaggtgaaaattaggttggagatgttggattcgagttagtttttcgagattatttcgtttatttcgggcgtgtagtagttcgggaattcgaagtgcgagtcggagtcgggttcgaagttaaaatttaggtttcggtcgagcgtcgacgacgaattgaagttgtttagggatatgtttttaaagtttgagttggggtttaggtcgagtaggtcgttttcgaattcgtcgtcggaggacgaggagttcgaggaggaggaagaggaggagtgggacgaggtcgaggaggacgcgtgcgagggcgcgttggacggggcgggcgaggcggcgcgtaggttggcgtagtcgcggtggtcggcgggcgagcggtcggcggcgggggacgaggcggcgttgttgcggtcgtttaggttgggcgcgtcgggcgagtagttcgcgttttttttttcgtataggtttagggggtcgttggggtcggttttcgcgtttacgtcgtttacgggcgacgacgacgtgtttaggtcgtcgaataggtagacgcgttttattttttttttcgttaggtgtttgttcggggtcgcgagcgttgcggaggtcgaggttgtcgaggaggcggaggtcgaggcgttgggagttcgcgttttgtatagcgagtggtggtcggcggcggcgtttaggggtagtagggcggcggttttcgtttgttcggcggcgaaggaggcggcggcggtagtcgttgttttttcgtcgtcgtcgtcgtttgttaggatgagtttggcgtgcggtttgttaattttatcgttcgcgtcgttcgttattttggagtcgtagttttttttttgcgtcggtttggagttggcgtcgtcgttattcgtatcgtcgtttttttttttcgcgttgttgttttcgtcgtcgtcgtcgtttttatggtcgttttcgttattgttatcgattttgttttttttttttttcggtttggaggaggcggcggtcgaggagttggagttggcgttgtcggattttattttttttttgggtcggtatttgtagtcggggtagttagttatgtgtttgaggcgtagtcgtttcgtttttcgaatgaaagggattttgtcgttgtttttgagtagtttttagcgtttgtttagtcgtttggagatttcggcgttgtgtatgtcgggcgattgttttatgattttgcgtcgttcgatttgcgattatattatgaaggcgtttatgggtcgtttgatgtgtttattcggggttttgtattagttcgggtcgtcggttttgtcgttcgtggaggcggtggagtcgggcgtgggggaggaggcgatttttagttcgaggtcggcgttcgagttcgagttttcgtcggttagtagcgttttcgtgttttcggtattgttggtttgttgtattatggtttcggttcggcgggcgtttacgcgcgtttatattttcgcggcggtcgtcgcgcgatcgtcgggttttttcggtttttcgggttaagtatacgtcgaacgggaagacgcgcgcggcggtcgaattggttttttaatttttcgtaggggcggaggtgggtaaagagagaaaagtttttaaaagatttggggaaggagtttttcgtttttcgtagaggagttatagtttttaggttggagagtttttttttttttttttttcgtttttttatcgcgttgtagtttgttgtttttcggttgagtttggagatcgtgttaaagtagagaggagtttttcgaatgttggttgttgaagtttttaatgtaagtttttcgcggttttttaggtaagttttttttttttttttttttttttttttgaagtagttgattttagtttacgagcgttttcggtagtttaggaaagcgatatagtttttagtatttagttttttttttataatgtaaagtaaaaaagattgtggttttaggattttttgtgggcggaatcggtattaaggagttggtgtaattattttgttgtaaggtaggaagttaaaaagtttgtatgtaatagattggtatgaataaatgtatgttttttttttttttttgtaagaagggagttggtaatggtaggagtttttttagtgtagatttttaaagagcgtgtaagaattagagattcgatagcgaaataggttttttttttttatatatagttttttttgttgtagtttagagtagattttaatttcgtttcgcgtttttttatttttttatagttttggttgtagttaattagttgttgtaattaacgtttttttatgttaaatttttttttcgggttttttattggtttggaattcgatgtaataataattttcgcgtgtaatgagaagttttaaatttgattttattttaatttatagagtaaattttttaaaagggttagaagtatagttgagatttttgttgttttttttttttttttgttgtgtgtgtgcgcgcgcgtgtgtgtgcgcgcgtgcgtgtgtgtatagtgtgtgaagaggatgttaatgtatgaaattattaaggggagagacggaaatgtattttaattattatgttagataataaggggtttggaacggggcggggtaagggtgaaatattgtaaatggaagttttttgtttaaaagttaagtgattatttttattagttttttttagtattggaataaagaattagtttttggtgtaaaatttgttttttagtttttttttaaagttaaagttgtaaaggggaagagaaagttataaaataataaattaatggatattgaaaattattaagaaagtggtatttagatatttgttattataattattttaataattttaggtatagtatagatgttgatgtattgtgtaaatttttttagaatcgtttttgtgttgtttgtggaaggtagggaagaggattttgtaataattgtttatttttttaattaagtaagggttaattatggttatttaatgatttaaattttttgtaaattttgtatagtttaaataggggagtttttttttgaaatatattaggtagtgtttcgtaattattttaataggtagatttttagagttttgtataggatgtataatggtatgtaaaggatggaaatcggttttattttttaaatatttgttttttttgtttttaaaattaaagattgttttattttttttttttttttttttttaaagttatttttttttttttttttttatatatttttttttgttatttgaatcgaagggaattgaaaaattaaggtaaagagaaattgtagaaggaggtgataattggtagtagaagagaatggggttttcggatttatagtagatttggttgttaattttttttaatggtttgtaattatggggatgtggttaagttttagttttttttatttattatatgggaatattaggagttattttatagagggttgttgtgagggtttaatgaatttgtgattatgaagtatttgatgtattgtaagtttttaatgaatattaatatttttttttttaatttaaatgttagatatatttttagtaaaagttgtatgttgtttaagaggttaaaatagaatagttatttatgtaaaaaagtaataataggtaggacgcggtggtttacgtttgtaattttagtattttgggaggttaaggtgggtggattattttaggttaggagttcgagattagtttggttaatatggtgaaattttgtttttattaaaaattaaaaaattaaaaaattagttgggtagggatgtatgcgtttgtaattttagttattcgagaagttaaggcgggagaattgtttgaatttaggaggttgtagtgagttaagattgagttattgtattttagtgtgggtgatagcgtgtgattattttaaaaaaaaaaaaaaagtaattatagattattgatgtgaattatagaaggataatagtggtaattttgttattttattgattttaaaagaaaggaattttatgaagaatattaagaagaatgtggtaaagaaaggatgttaaggtatttaaaataaacgttggttatagaaattatttgttttttagtgtttgaaaattagaattgtagtaaaaattagttttttttaatattataataggaaattaatattttttaggttaattataagtggttaggtaaagttaatttaaaataattaagtcggtttttgatttagattaaattagtgttgggtagtaaatttttatgtattttgttaaatttttaaagtatgtaggttggtaataggtttaggttgttagatttagaattttattggaaagaatattttatgtagttatttgattggatttgtaaggattaattataagtaaaattgtttttgtgggtaaaagtaaataatttttgacgattagttatttgtattatataatttttttaaaaaaggagaaataaatttttaaaaaaagaaaaatttaaattaaaaatatataggtattttttttgtataatagtgttgttgtgttatatattatattttttttggtgtgtatagaaatatatttttaaatgttattaatttgataaaaaaaaattattttaagagggttattatttataagattaatatttttattagaataaaaaagaatatttatttttgaatttgtattaattaatgatttgagggtgtagttagtttgataatttagttaagttgagtattaatattattgattatattttttagttatttatgtttttattatcgaatatgatagggaagagtggaagttaaagtagttatatatgtttttgtttaaaatatatggattttttaaagggtgtattaaaatatagttattggttttatttttttgttatatgtattttttgtattttaataaatttaataaattttaagatatattattatattatattttattaaggaagaaagttgttaatgaaattgtgatatttttttagatgtaggatgtttttttattttaggaagagttgaaatgaaaagaaaaatttttttttagatttgatgaaatatggtattagtaatttttattgattttataattattgtatatatatttatatattatataagtgtttagatttttgaaatagatttgttttaatgggttagtttttttagaatgtaagaaaatatatgacgaatgtttttttattaaagttatttttgtgattaattaagtgtgtgtatattggaatgtgttggattttttaatattaaataatgagaaaagatttttttttttttattttttaattttatatgttttgtaattagttttttattattgatatttttttttttaaatattagatatttggtggtttttattaaattagtacgtagtgttttttttgttggttttgtagtatatgaagtaatttttaatgttagttttttagttgtattaagagaaagttaagataattttgtagaaaaaaaaaattttggtttagaataataaattgtttttgttagtaatgatgttagatatttttaattttgaattaggtattttattttatttttttaaatgatggaattttatttgagatgtaagtgtaatatttgttaatgtattttttttgtttttatatatttatataatataaaattttatatttatataatggtatggggtatagatgaaataagattttattttattgtttaatatatttttttggtatggagggagggatttgaatggaaattagtttaataaatttggatttgtattgatttgtaagattttgttttgttttggttatagaaattatgattgtaggcgttagttagatttgataagtatttagtttaaataaaataaagaggaggaaaaattgtgtagttgttattttatttgataaggaagaagttttgggaaatttgatgttattggtttttgttaattgaaaggcgttagtttttttggttttatattttatggaaaagaagtttttatgtgaggttgatttattttttagttaagtagataaatataatttgtattttatttttttgggttgatgatattgtattgtaattgggtttagcgcgtaatgggggtgggggtgcgtgtattgaaaaataatatatggaaataatttatatttgtaaaatattaaaataggattttggggtaaatgaaatttagtatttatttttattattagaataagttaagagttaagaaatttgtatttttaataattgtattattttttttttataattagtgattagtatatagtaggtttaagttgtttatgttaatgttaatttattatttttttttttcgatttttttaagaaaataagtagaagacgaatgtttgtagggttatttggattgtaagtatgaatataggtttttgtttttattttagaggtagaggtacggtattcggggagagtttgggtttgtttgtagttagtcggtttttaatttggggagaagtagtcgttaggtggtatcgttgagtttttttgcgttcgcgaggcgaggtaggaaatcgtggggatagttagttttttttttttttttttttttttttttttcgatttttttattattttttattattgtattttttttagttagaggtttaaacgtttaacgagtaatagggtatgtcgatgaattttgatttttttttataaattaaagtttagggtaattattcgtcgttttttgtttatttgttaggagttt

SEQ ID NO: 145 - DNA, 5986 bp, Artificial Sequence
  chemically treated genomic DNA (Homo sapiens)
  unsure (946)
aggtgtttttattagggtatttagggtgtttcgttttttgggtttataaaagttatagtgtgaagggatgttgttgtttagatttttttgaggttggggttttggtttgggaagtttttaaggttttgggttttgttattttggatggtatttgttttttgaaaattttgtcgttgtttttggttttgaggtgttatagtgtttttggttttgaggttttttagtatttgttagatgtggagttgttttttacgtagggattttgatggggtgtattttagatttgtgtattattgtttttggttttttgagtgcggtatatttggttttaggaaattttgtattatatttttttttgaagagtttgggtttcgttttgtcgtttaggttggagtgtagtggcgagtttatagtttattgtagtttttaatttttgggtttcggcgattttttcgttttggttttttgagtcgttacgtttagtttttatattgtattgttttttcgtggtttaacgttttttcgtgttaggttttggatttggagtttcgtagagtggggaggtttttgttttagggtttatttagtcgtagtttttttttttttttatgggatgttttatcgatttttttgtttggattttatgttttagggattatttggatttattttagtttttgttttagattggggtttttggtgtgggggttttggtattgtcgaggggttttaggagttatttttagttatatagtgtttcggtttattttattaggtttagggtacggtttttatgtttttaaattgcgtttgggattttgtttatttttagtttttggggggcgtttttagattggggtttggttttttaggtttagggttttgttatgtttttttttaggtttattttttatattatggtttattagtaagaagcgttacgagntcgttgttttttttttttcggttcgacgtttacgatcgtatggattgtaagggtttggagcgtgcgtagggataattgttttttacgtggttaatttggttattgttttattgcgtcgtttgtttatcgatcggtgtgtggggtttttttttttagatttagggggttgggtaatatttttttttttttagatttaggagtttaggttttagtttttttttttttaggtttacgggtttaggtttttagtttttttttttttagatttcggggttagggtttttagttttttttttttttagatataagagtttagatttttagtttttttttttttgggaatataggtgttaggtttagttttttttcggtggtgaagtagtggaaagagtcggtttaggtagttgtgggtttaggttttgtttttgttattttgtagtttatggtaggaagggtttttttttgttttgagttttagttttaagagtttattttggtttttagttttgagattcgtggaggtattagtttgtttttagtgttttttggtgacgttgtgcggttcgtttttttatagagattttgagggcgcggtggtttacgtataggacgttatttcggatttgttgtgtaatcgtatcgatattttttagttggttattattaaggagttgattcgcgcggttttcgattatgtcggtaagtaggtttacgtggagttggtcgagaggttttgcgcggggcgggtggtttggttagaaataatttttttttttttgttagttgggtttattttttatattttcgtttttattttcgttatttatttgtttttatttattcgttatttcgtttttacgtaggatgaggaagcgggatttcgggagtgcgtttagtttgggcgatcgcgttttttacgtgattattagtgtcgttaagggtgtggtcgtttatatgaagtcggaggttaggtttatttggttgtttgttttcgtttagttttttcgtttttatttttgtttttcgagatgggcgggtttgcgggaagggtggggttttcgcgtgtttgtgggttttgtagaatcgttttttatggtagtttgggtgtggtttcggtttttttggaggttttttttttattttgattttttttttgtttttttatggaaggattcgagtttttattttgtgtatataagttttttagttcgggtgtttttttggatttataattttgtagttttattattatttttagtatttatattttagttttatgatttttgattttttgattttttttttatttttgtttttttttgtgaattttgattttttcgtggtgatttgagagttttatagattttgtggtttagagatttcgtgattttcgattttattttagatttaggttttttttatgttatagttcgtaggtaggtttagttttaagtttaggttttatgattatttcgtgtttatttcggtgttttttttttggttgttcgggtgtgattgttatgtggcgtagattcgttgttcgtgttggagtaagtttgtttattgatacgtagtattatttggagtagtagttggttaagtttttttgcgtattttcgagtttattttggaggcggtcgtgcgaggttgtgttattgcgtacgggggtataggggattgggggtatttgcggggggtagcggcgagattatcggttattatttgtttttttttttgtaggggggatatacgcgttgaagacggtgtttacgggtaaggtgggcggttttttgcgttgcgttaaacgtcgtaattgttgtattggttgtcgtatagtgtttagttattagggtgagcggttttggtatttgggtttttattggtttttaatttgttttgtcgttattttagattttagatatttattttatcggttggtattgtatcgagtgtttagagtttttgggcggtggtttttgtttttattttttatagagggttttcggtttttatttcgggagttttttaggggagtttttttagtatatttgtttcgttgttttttagtttttggggatttttagaagttgggattggtagtgggtagggatggggtggtttagtttttggttggttttagtatttgggttgattcgtttttttataggagtcgtgtgtgagttttgttagtttcgggagtttgagttgtattagaaggaggtgagagggtcgggagttgaggaggggttaggtggggaggcgggggcgtttgtttagtcgttgtcgtttttaggtattttatttgaatgttttggaggagcgtttttcgcgttttggacgtagtgttagcgttgttagggtagttgtacgaggacgttatttgtattaggtgtgtgtcgtgtttcgattttgggttgttttgtttttttttagtttttaggtttgtgggttgtggatttaatttttgattttaaggttttttttgagtatttttttcgtttatttttttttagttgtgagttgttttgagttttagtgtttttgtttgaaaaatgggtttattttagttttttagaggtgcggtgtttagggaggtagcgtcggtatttagtgttgttcgggaaacggttgttttttcgatatatttagttagtttggttttttttttagggcggggcgggttattttttagggaacgggtaggcggggtgggtttttacgtaggtgataggtgatatacggttagttatgcgttgtatttcgttaggtattcgttgttatcggtttcgttttttttttgtttgttgagtaaatagttcgttgcgggagggggcgggtgggttgggtagtaggcggggattaatagttttcgggaatagtttttattttttttttaggatggttattgggttttggttggttttgattttgtttttgtttttggttttattcgtagtcgggattgttttattttttatatgcgtaagaaggtgcggaaggatttggaagattaggagtagtttttggcgtttcggattttttggatttgaggtttggtgattttgtaagtattttatggggcgggggcgggattagggagaattaataaagttttggatttttgttatatggtgttttgtggtttttgggggatattgtttggttttataagttttggttttggttgggatttttttgaggttcgtatcgttttttatttttagtaaaagttttcggatttttatttgtgttgtttggtttatgtgggttaagtttgttttagttttttttttggttttgaaggaatttttatattagcgtttttttgttttgtttagggttttaggtgtttggtttcggttagttttttttggtgatgattttggggattttggtggttgtttcgttttttaggtgttgatttgttttttttaggttttggcgagttttagcgtatcggcgttttattttttagttcggttaagggatttttttatttttcgtcggattatatatttacgatgtttttacgtcggggttttggtaatgggttttgggtttgggtttttttttagcgatttttatttttattttcgtagtttttaattgtcgttagatgttttcggttttttcgttattttatatatttttcggggagagttttgtgtttgtttttcggtttttagttcgtttttgttggaattcggtttttgggtttagatttttcgttttttgatttttttttttagtgaattttagttttttttcgatgtttttagggttttttaaatttagtttttgttttatttttagtttttaaggttagttttttaaatttagttttacgggatttttaaatttagatatttttgttcgttatttttgttatgtgataaaggggttgtgtaatttagtttttttttttgattttttttgaggggatttttgaggagggtcgagtttgtggttagcgggtatttttttttttcggtagggttgggttaagatataaatagggttggcggttcgttagcggtaaatagttcgttcggtattattatgttcgttttggaggttgtatagtaagtgaggtttttaaatttgtattcgggtttttatttgtattcgtttttgtggggttttatttatgggtagtggtttttttgttttttacggtcggtgggtgggagtggaggggaggggtttgttttgttttttgttttttttggttttgttttttttttatttcggattttttatttttttagtttttattttttttggtttttaaagattttatttttttagaatatttgttagcgtgtttttttgcgggcgtttttcgtggtttttattttgtttatttttttgttttttcgagttttcgtatttgttcgttttgtatttggtattttttagtttttaatattttgtttgttgttttttgtttttttgtttgtttttgtgtttttgtttttagttttcgttttttttgttttttggtttttttttgttttatttttatttttagtgtttttatttggggttttaggaatttttttcgtttttgtgcgtgaatgtttttttgtatatttttttttgtgttttatttttttttgagtttttttatttgagtttttttcgggtttttttttttttatttagatatttttttattttttttttttggtttaagttggatttaattgattcgttattaaggtcgtatttgatttaggttttttttttatttttatatttttttttcgggatttttttttttttattttttttgtttttttttattagggtgtttatgtaaattttggggaggagggggatatttgttttttttttattttttattttttgttttagtagggggtagtgggggagttcggtgaatgtggtggggttggttttttatatagggttgcggtggttatagttgttgtcgtttttttattagtttttaattattttgagatttaggtggttggaggtagttttagtatgtttttgtgtttttttttttttagg

SEQ ID NO: 146 - DNA, 5986 bp, Artificial Sequence
  chemically treated genomic DNA (Homo sapiens)
  unsure (5041)
tttggagggggagagatataggggtatgttgaggttgtttttagttatttgaattttaaagtggttgggggttgatggggaggcggtagtagttgtgattatcgtagttttgtgtgagggattagttttattatatttatcggatttttttattattttttgttgggataggaagtggggggtgggggggaggtaaatgttttttttttttttagaatttgtatagatattttggtggggaggggtagggaaagtgagggagagaaagtttcggaaaggaggtgtggggatggagagggggtttgggttaagtgcggttttggtggcgagttagttgagtttagtttggattagaggagaaggatggagagatgtttgggtagagagggggaagttcggagaagatttagatgaggaggtttaaggagaggtgggatatagagaaaggtgtgtaaagggatatttacgtatagaggcggggaggatttttggagttttagatggaggtattgagagtgagggtgaggtagaaggagattaaaaggtagggagagcgagaattggagatagagatatagagataggtagagagatagagagtaataggtagaatgttgagagttgggagatgttagatatagagcgaatagatacgggaattcggggagataggaggatggatagagtgagagttacggaggacgttcgtaggagggtacgttagtaagtgttttggggaaatgagatttttggggattaggaaagataggaattggggggatggagagttcgaagtgaagagggaatagaattagaaggggtaagagatagggtagattttttttttttatttttatttatcggtcgtgaggagtagagaaattattgtttatgggtgaggttttatagaggcgagtgtaggtggggattcgggtgtaggtttgggggttttatttattgtgtagtttttagggcgagtatggtggtgtcgggcgggttgtttgtcgttggcgagtcgttaattttatttatattttggtttagttttgtcgggggaggagggtgttcgttggttataagttcggttttttttaaaaatttttttaggaggggttaggggagggggttggattgtataatttttttgttatatggtagggatggcgggtaggggtgtttggatttggggatttcgtggggttgggtttggggggttgattttgagggttggagatgggataggagttggatttggggaattttgaaaatatcgaggaagggttggggtttattgaagaggagaattaggaaacggaggatttggatttaggagtcgaattttagtaggggcgggttgggggtcgaggggtaagtataagatttttttcgggggatgtgtgaggtgacgggagggtcgagggtatttgacggtagttagaggttgcggggatagagatgggagtcgttggggggaaatttagatttaaagtttattgttaggatttcgacgtggaaatatcgtgggtgtgtggttcggcgggggatgggggggttttttggtcgggttgaggagtggaacgtcggtgcgttggggttcgttagggtttggaggaaataggttagtatttggagggcggggtagttattagggtttttagggttattattagggagggttggtcggggttagatatttggggttttaagtagggtagagaagcgttggtataagggtttttttagggttagagaggaaattgaggtaggtttggtttatatgaattaggtagtataggtgggagttcgggggtttttgttgaggatgaggggcggtgcgggttttaggagggttttagttaaggttagggtttatgaaattagatagtgttttttagagattataaagtattatgtagtaaaagtttagaattttattaattttttttggtttcgttttcgttttatgggatgtttgtaaggttattaggttttaggtttagggggttcgaagcgttaggagttgtttttggttttttaggttttttcgtatttttttgcgtatgtagaagatggggtagtttcggttgcgaatggggttaggggtaggggtagggttaggattagttaaggtttagtggttattttgggagaggggtgggggttgttttcgaggattattggttttcgtttgttgtttagtttattcgttttttttcgtagcgggttgtttgtttagtaggtagggggggggcggagtcgataatagcgggtgtttggcgaggtgtagcgtatggttggtcgtatattatttgttatttgcgtgggaatttatttcgtttattcgttttttggggaatagttcgtttcgttttggggagggggttaggttggttgggtgtgtcgggaggatagtcgtttttcgggtaatattgggtgtcggcgttgtttttttaagtatcgtatttttggggggttgggatgggtttattttttagataaggatattgaggtttaggatagtttatagttggaaggggatgggcggggaggatgtttaggagaggttttggagttagaggttgggtttataatttataggtttgggagttgggaaggggtagggtagtttagggtcgggatacggtatatatttggtgtagatgacgttttcgtgtagttgttttggtagcgttggtattgcgtttagagcgcgagaagcgtttttttagggtatttagatgggatatttggggacggtagcggttaagtaggcgttttcgtttttttatttggtttttttttaattttcggtttttttatttttttttgatatagtttagattttcggggttggtagaatttatatacggtttttgtggggaggcgggttagtttaagtgttggggttagttaggaattgggttattttatttttgtttattgttaattttagtttttgaaagtttttagaggttggagaataacggagtaagtgtgttgggaaaatttttttggggaattttcggggtgggggtcgaggattttttgtggggggtggagataggggttatcgtttaggggttttgggtattcggtgtagtgttagtcgatggggtgggtgtttaggatttggggtgacggtagagtaggttgagggttagtgggggtttagatgttagggtcgtttattttggtggttgagtattgtgcggtagttaatgtagtagttgcggcgtttggcgtaacgtaggaggtcgtttattttgttcgtgagtatcgtttttagcgcgtgtgttttttttgtaggagaggaggtaggtggtggtcggtgatttcgtcgttgtttttcgtaggtgtttttagttttttgtgttttcgtacgtagtagtatagtttcgtacggtcgtttttaggatgggttcgaagatgcgtaggagggtttggttagttgttgttttaggtagtattgcgtgttaatgggtaggtttgttttagtacgaatagcgggtttgcgttatatggtagttatattcgggtagttagggaaagggtatcggggtggatacggggtggttatggggtttgggtttagggttaggtttgtttgcgggttgtgatatggggggggtttgggtttgggatggggtcggaggttacggagtttttgggttatagagtttgtagggtttttaggttattacggaagggttagagtttataaggggaagtaaggatgaggaaggggttaggaggttagaggttatggggttaagatgtgggtattgggggtggtggtagagttgtaggattatgaatttaagggaatattcgagttgggaggtttgtatgtatagggtagagattcggatttttttatagggaagtaagggaggggttagaatagaggggggatttttagaggggtcgaggttatatttaggttgttatggggggcggttttgtagggtttataggtacgcggaggttttatttttttcgtaggttcgtttatttcggaaagtagaagtgagagcgagggggttgggcgggagtaggtagttaggtgggtttgattttcgattttatgtaggcggttatatttttggcggtattgatgattacgtaggggacgcggtcgtttaggttgggcgtattttcggggtttcgtttttttattttgcgtggagacggggtggcgggtgggtgagggtaggtgggtggcgggggtgggggcgagggtgtaggaagtgggtttagttggtaggaaggagggggttatttttggttaggttattcgtttcgcgtaggatttttcggttagttttacgtgggtttgtttgtcggtatagtcggaggtcgcgcgggttagttttttggtgatgattagttgggagatatcgatgcggttgtatagtaggttcgagatgacgttttgtgcgtgagttatcgcgtttttagggtttttgtaggagagcgggtcgtatagcgttattaaaaggtattgagggtaggttggtgtttttacgggttttagggttggagattaggatgagtttttagggttgaggtttagggtagagaggggttttttttattataggttgtagagtggtagaggtagggtttgaatttatagttgtttaagtcgattttttttattgttttattatcgaggaagagttgggtttgatatttgtgtttttagaggaggaggggttgggggtttggatttttgtatttaagagaggaaggggttgggggttttgatttcgggatttgaggaggagggggttgggggtttggattcgtgggtttgagggaggaggggttggggtttagatttttgggtttgagggaggaggggtattgtttagttttttgagtttgagggaggaggttttatatatcggtcgatgagtaggcggcgtagtgaggtagtgattaggttggttacgtagggggtagttgtttttgcgtacgttttaggtttttgtagtttatgcggtcgtgggcgtcgggtcgggaggagaagagtaacggnttcgtagcgttttttgttgataagttatggtatgggaagtagatttgggagggagtatggtaagattttgagtttgaggagttaagttttaatttggagacgttttttagaaattgaaggtagatagggttttagacgtagtttgaggatatgggagtcgtgttttgagtttggtgggatggatcgagatattgtatggttggaagtggtttttgaggtttttcggtaatgttagagtttttatattagagattttaatttgaaatagagattgggataaatttagatagtttttaaaatatgagatttagataggggagtcgatgaagtattttatgaaagagaggagaaattacggttgggtgagttttgaggtagagatttttttattttgcgaggttttaagtttaaggtttggtacgagagagcgttaagttacggggaaatagtatagtgtgagaattgggcgtggcggtttaggaggttaaggcgggaggatcgtcggagtttaggagttggaggttgtagtgagttgtgaattcgttattgtattttagtttgggcgatagagcgagatttagattttttaaaagaaaatatggtgtaaggttttttgggattaagtgtgtcgtatttagagggttaggggtaatggtgtatagatttaaggtgtattttattagggtttttgcgtggagggtagttttatatttgataggtattgggaaattttaaaattagggatattgtgatattttaaaattagggatagcgatagggtttttaaagaatagatgttatttagggtaataaagtttaaggttttggaggttttttaaattaaggttttagttttaggagaatttaagtagtaatatttttttatattgtggtttttgtgaatttaaagaacgggatattttgagtattttgatgagggtattt

SEQ ID NO: 147 - DNA, 6874 bp, Artificial Sequence
  chemically treated genomic DNA (Homo sapiens)
gtttattgtaatttttattttttgagtttaagcgatttttttgttttagattttttagaagttgggattataggtgttcgttattatatttagttaattttttttgtatttttagtagagatagggttttattatattggttagtgtggttttaaatttttgattttaagcgatttattcgttttaattttttaaagtgttgggattataggtatgagttatcgtattcggtttatttttgtttaattttaaaagaaaaatataaaagttatattgattgttaaagaagttatatggtataaatttatataaagtaaaaaaatatattttttttattttaaattttattttttataggtaagtattattagtgtttggagtgtggttttttagattttttttgggtataatgatttataaatttttttttattattgttaatgttgttattataattgatattttttttgtttttgtgtaaaattatgaatttttgagtaaaggttaattttaaatgaaaatagatttagggtattttgatagtaattttttttttttttttgagatagggttttttttttatttagattgagtgtagtggtgttattatggtttattgtagtttgggtttaagtaatttttttattttagtttttttagtagttgggattacgattatagatgcgtgttattgtgttttagtatttttttttttttttgagatgaagttttatttttttatttaggttggaatgaagtggtacgattttggtttattgtaattttttttttttagatttaagtgatttttttgttttagttttttgagtagttgggattataggtatatattattaggttcggttaatttttgtatttttaggagaggtgggatttttgttatgttggttaggttggttttgaatttttgattttaggtgatttatttttttaggttttttaaagtgttaggattataggtatgatttattttgtttgtttgtgttttttttttttaagagatggggttttattgtgttgtttaggttggtgttaaaattttcggatttaaattatttttttattttgattttaaaaagtgttgggattttaggtgtgaattattgtatttagttatgatagtaatttttaaaagtaatttttaatttttgtttgttattagttaggtgataaaaattagaagaaagaaagaaaggttagggtggaatttgtgtggtgtgagggatttggttgaaatttttatgtatttatagaggttttttatggtttggggtggatatgagtttttatttgttgtaaggtgttattttgattaggttttttcggaggaatattttaattttatattttagagtagttaggtaggagtttatttaggtttagtaggttgcgtggagtttatggtaaagtggagagttttttttatggttattattagttttaggttataatgtttttgtgggtatttaggtttagtgttattaaaaattttgatttttttgagagaggttagatatttagatttttttttttttttgaaaaggagttttatttcgtagtttaggtcggagtatagtggttttatttaggtttattgtaatttttgttttttaggtttaagtgatttttttgttttagtttttcgtgtagttgggattatagatgtgtgttattatgttcggttatttttttatttttttagtagagatggcgttttattatgttggttaggttggttttgaatttttgattttaagtgatttatttattttagttttttaaagtgttgggattatagatatgagttattacgttcggttagatatttagatttttatgtaaatttttatgatttttaaatgttataaggtttaaataaaatatttttatgagatagtttttgattttgattttatttttagtaatatttttggttttggaatttgtagtaatttaatagtgtgggtagaggtttttttttgattttttgtggtgataaaggatatgaagatgggttattttaagtagatagagaagttgtgatattaatattggtgtgtaatgatttaggagttgggagaagttgaagagagggtagtttatttgaagggaagttaaggattgcgttttttttagatatttttttttatagatgtgatagagagtagttgtttttgttgagggatgttatttttgtatgtgtttaaattagggggcgtaaatgaaagggtttttagagggtaggtgggaatgaaattttagagttttggttgtaatattatggtgtttagataaaatatgattttaggtattatttgtggtttttaaaatttttttggaatttatttatttgtttgatttgtttttttttttgggttaatacgttttatatgtttaagtatttgttgtaaagagtaaattagtggagggaggggagatttttttaaaattattgggggttgggtgtagtggtttaggtttttaattttagtattttgggaggtcgaggtgagagaatcgtttgagtttagaagtttgagattagtttgggtaatatagggagattttatttttatatgataaaaaatatatattatattttatttattatatatataaaatatatattatattttattgattatttgtatatattttattttagtattttttaagtttttggattgtgatttatagtaagaaatgtagttaatattgttatttattatatatatatattgaattatgagaaattgataatattttatttttttgatttataaaatggtaattttgtagggtttaatttatatataatgtaaataaatattttatgtaataatatttgtttttgttttttgtgatatttattaatttatttttttaaatgttgattgtagtatattgaattgatattattattattattagtaatgattaggttataattaattgttttatttaatttttataatttttcgggtaggaataattattgttttttatttttttaaatatgttaagatgttttatttttaggatgaggtgatttattttaggtaatttttattgtttaattattgattaattattttgttttttagtttttatgttattaaatttgtattaagaattttatggaataggttcggtatggtggtttatgtttgtaattttagtattttgggagatcgaggtgggaggattatttgaggttagtagttcgagattagtttggataatatggcgaaattttatttttattaaaaatataaaataattagttaggtgtggtggtgggtatttgtaattttagttatttgggaagttgaggtagtaggagaatcgtttgaattggggaggtagaggttgtagtgagtcgagatcgtgttagtgtattttagtttgggcgatagagcgagattttgttttaaaaaaaaaaaaaaaaaaaatttagggaatggatagtagtattgatgaatattgcgtttggagagattagattatttgttatttgtttttaggtatagggtttattaagaggtagattttagatttaaataattttgtaatagtaaagtttaagttatttttattgttttggagaaaagatttagatttagagtttgaattttattttgtagtattttagttttaattttttaagtttttttttttttttttttttttttttgttgggtacggtggtttatgtttataattttagtattttgggaagtcgagggggaaggatcgtttgaggttaggagttcgaaattagtttgggtaatatggtaaaattttatttttataaaaaatataaaaattaggttagagtggtggcgcgtatttgtagttttagttacgtgagaggcggaggtgggagaatcgtttgaattcgggaggtagaggttgtaatgagtttagatttcgttattgtattttaggttgggcgatagagcgatattttgtgtgaaatttttttttttttttttaacgggttttttagagaagtgtgtgtatgtgcgtgtgtgtgcgcgagcgtgtttgtttgggtttaaattttttgtcgggttatatttttttaagtttttgtattggttgtagggtgggttttattttcgggacgtttttttttttaagtttagtttgtagttggaagtttttattgatttttattttttttttttgattttcgttttttttttttgttcgttttaggattgggaggtcgatttttttttttcgtttttttttttattagttttttttagatgtatgtttgttaaagattttttagtgtagaggatgatgaatgaagattttcgagttagttcggtgggaaagtttcgtcgtttataaaagcgagggaaagggaagggaagttgggggtaggggaaaagttagagttgagaggttggggcgcgacgagtttggatatcgggcggggatttaagtttttttcgtttagttaataattgtgttttttttaggaaggcgtgaggaaatgttttaattaatttttgtattttttttttggaatttgggttgtatttttttatttattgtaaattttataatttatttaggggtttttttagtgtttgtttttagcggtttcggtgtttatttattagtgttgttttttttttttcgtaagattgcgttttagttttagttttttttttcgcgggtgttttttaaatcgttttattattttcgggtttagggaggcggaatcgtgtttgtttttcggtttttttaagaggcgtcggttttattttttttagagtcgcggtttgacgcgagatgatagtaacgagttcggtatgtttatgtaaataagcgtttttttgtgggttaatggggagcggaggtgtcggaattacggattaatggggcgggggcgttggggtttattatataaggagcggtttcgttataaaaggaaatattgtatttttttatatggggggaagggtcgggggattttttcgtcgttagcgcgtggtttcggttttttttattcgtcgtttcggtcgcggttagtagtttttgtttttcgggggacgttgacggtcgttcggcgcgtcgttttagtagacggatagggggcgttgcgcgcggtttggggtaattcgggttataggggtaggaaagtgagggtttaggtcggttcgggcgtgtaggggtttcgggttcgtagcggcggtcgcggtagcgatagcggtattagtagtagcgggagtgtcgggttgagtcgggaagtcgatggcggcggttgcggcggtttcgatttttcgttgattgttcgttcgtttttttgtatcgagcgttatgttatcgatttaagttggggtcgcggcggttttgggtcggggttcggttttggggggtagtttgaatcggatttcgacggggcggtcgggcggcggcggcgggatacgcggggttaacgggggtcgggttttcgggaatggcgcggggttcgggttcggtcgtttggagcgggaggttgcggtagcggcggtaattatttcggcgtttatcgcgggggttttttatagcggtagcgagggcgattcggagtcgggcgaggaggaggagttgggcgtcgagcggcgcggtttgaagcggagtttgagcgagatggagatcggtatggtggtcggtgggttcgaggcgtcggtagcggttatcgggggttacgggtcggtgagcggcgcggtgagcggggttaagtcgggtaagaagattcggggtcgcgtgaagattaagatggagtttatcgataataagttgcggcgttatacgatttttagtaagaggaagacgggtattatgaagaaggtattaagtcggggggttggtcggtttcggggttcggttggggtggggatgtgtaaagggagttcgggaggatcgtagagtcgaggcggaggtgagaggttgcgagttcgtaggaggtgtgtgggaggggatggtttttgttcggggagggtcgaaggggaggggtcgtcggggaaatgtggggagaggggagatttcgcgaacgttcgtaatcgtggggaaaggcgtagaggtgggagtgatcggcgttagagaggaagagggtttttgttgagtgaaggggtgaggagcggtgatgggaggttacgaggttgtcggggaggtggataatgagaattcgggattagtaggtttagtgtatttcggtgttcggacgagggcgtcggaaaagtagggagtaaacgagaaggtatggaggtgaggaggttggagttgtatgataataatgagcgaatatgtgtgggaggaagtgggtattacgagagtagtgttggttggaaggataggtagggttagggattaggtaagggagcggggtaggagaattggtgttgttttgagtagtaggaatttagttttgcgtcggtcgtgagttttttatggtatttattgggaattatatgtttttggtaggattcgttgtagaattttttgtcgttaggataagtggggtttttagttttagggagaatttatgtttggatggggtttgggggaagttagggaggtttgtagaggtatttaggaattttttttttgttagttagtgaaaagtgttgaggaaaggagttattttggggtgtagacgataagggaagagatgaaagtagaggaattgggagataaggagttggatttttgggaatattggttggtgtttatttttgttttatgtagaaattagagttgtttttaaggtggtttgtagaattttgttgggagagtatggtatttatggggttatttttgaaggttttttttttgggtttatggtaggatgttt

SEQ ID NO: 148 - DNA, 6874 bp, Artificial Sequence
  chemically treated genomic DNA (Homo sapiens)
aaatattttgttatgagtttaggaaggggatttttaaggatggttttatagatgttatatttttttaataaagttttgtaaattattttggaagtagttttggtttttatatgggatagaaataaatattagttagtgtttttaaggatttagttttttgttttttagtttttttgtttttatttttttttttatcgtttatattttaaaatgatttttttttttaatattttttattggttggtagaagaggaatttttaggtatttttgtaagtttttttgattttttttaaattttatttaagtatagattttttttagggttggaaattttatttgttttaacggtaggagattttgtagcgggttttgttaggagtatgtggtttttagtggatgttatggaagatttacggtcggcgtaggattaggtttttgttgtttagggtagtattagtttttttgtttcgtttttttatttggtttttaattttgtttgtttttttaattagtattattttcgtggtgtttatttttttttatatatgttcgtttattgttgttatgtagttttagtttttttatttttatattttttcgtttgttttttgttttttcggcgttttcgttcgaatatcggagtgtattggatttattgatttcgggtttttattatttattttttcggtagtttcgtagttttttattatcgttttttatttttttatttagtaagggttttttttttttttggcgtcggttatttttatttttgcgtttttttttacggttgcgagcgttcgcgggattttttttttttttatattttttcggcggtttttttttttcggtttttttcgggtaggagttatttttttttatatattttttgcggattcgtagttttttattttcgtttcggttttgcggttttttcgggttttttttgtatatttttattttaatcgggtttcggggtcggttagtttttcggtttggtattttttttatgatgttcgttttttttttgttgaaggtcgtgtagcgtcgtagtttgttgtcgatgaattttattttgatttttacgcggtttcgggtttttttattcggtttggtttcgtttatcgcgtcgtttatcggttcgtagttttcggtggtcgttgtcgacgtttcgggtttatcgattattatatcgatttttatttcgtttaggtttcgttttaggtcgcgtcgttcggcgtttagtttttttttttcgttcgatttcgagtcgttttcgttgtcgttgtagagggttttcgcggtgggcgtcggggtggttgtcgtcgttgtcgtagtttttcgttttaggcggtcgggttcgagtttcgcgttattttcggggattcggttttcgttagtttcgcgtgtttcgtcgtcgtcgttcggtcgtttcgtcggggttcggtttaggttgttttttagggtcgagtttcggtttagagtcgtcgcggttttagtttgggtcggtaatatggcgttcgatgtaggagggcggacgggtagttagcgaggaatcggagtcgtcgtagtcgtcgttatcggtttttcggtttaattcggtattttcgttgttgttagtgtcgttatcgttgtcgcggtcgtcgttgcgaattcggggtttttgtacgttcgggtcgatttgggtttttatttttttgtttttgtggttcgggttgttttaggtcgcgcgtagcgttttttgttcgtttgttagggcggcgcgtcgggcggtcgttagcgtttttcggggggtaggggttgttggtcgcggtcgagacggcgggtggagggggtcgggattacgcgttggcggcggagggatttttcgatttttttttttatataaagagatataatgtttttttttatggcgaggtcgttttttatatggtgagttttagcgttttcgttttattggttcgtggtttcggtattttcgttttttattggtttataagagggcgtttatttgtatagatatatcgaattcgttgttgttatttcgcgttagatcgcgattttgagaggggtggagtcgacgttttttaaaggaatcggagagtaggtacgatttcgtttttttgaattcgagaatgatagaacggtttgggaggtattcgcggagaaggaggttgggattggagcgtagttttgcggaagagagggagtagtattagtaaatgggtatcgggatcgttggaggtaaatattggggaaatttttgggtggattgtggggtttgtagtaaataaaaaaatatagtttaaattttaagggaggagtgtagggattgattggagtatttttttacgtttttttaagggaggtatagttattggttgagcggagagagtttgggttttcgttcggtgtttagattcgtcgcgttttagttttttagttttaattttttttttatttttaattttttttttttttttttcgtttttgtaggcgacgaaatttttttatcgggttggttcgaggatttttatttattattttttgtattggggggtttttggtagatatatatttggaaaaggttggtggaggggagggcgagagagagagatcggttttttagttttgaggcgggtagggaggagagacggagattagggaggagagatggagattagtgaagatttttagttgtaggttggatttggggaggaggacgtttcgaggataaagtttattttatagttagtgtaaagatttgggaaagtgtggttcgatagaaagtttaagtttaagtaagtacgttcgcgtatatatacgtatatatatatatttttttggaaagttcgttggagaaaaaaaaaaaagttttatatagggtatcgttttgtcgtttaatttggagtgtagtggcgggatttgagtttattgtaatttttgtttttcgggtttaagcgatttttttattttcgttttttacgtagttggaattataggtgcgcgttattattttggtttaatttttgtattttttgtagagatggggttttgttatgttgtttagattggtttcgaatttttggttttaagcgatttttttttttcggttttttaaagtgttgggattataggtatgaattatcgtgtttagtagaaaaaaaaaaaaaaaaaaaaaaaaatttaaaagattagaattggggtgttgtaaagtgaggtttaagttttgggtttgggttttttttttaaagtagtgaaaatagtttggattttgttgttatagaattatttaaatttggaatttgttttttggtaagttttgtgtttggaaataagtgataagtgatttgatttttttagacgtaatatttattaatgttgttatttattttttgagttttttttttttttttttttgagatagagtttcgttttgtcgtttaggttggagtgtattggtacgatttcgatttattgtaatttttgtttttttagtttaagcgatttttttgttgttttagttttttaaatagttgggattataggtgtttattattatatttggttagttattttgtgtttttagtagagatggggtttcgttatgttgtttaggttggtttcgaattgttgattttaagtgatttttttatttcggttttttaaggtgttgggattataggtatgagttattatgtcgggtttattttatgaaatttttaatgtagatttaatgatataaagattaaagggtagagtaattggttagtggttaggtaataggagttatttggagtaagttattttattttagggataaagtattttggtatgtttaaggggatgggaggtagtgattatttttgttcgaaaaattatggagattaaataaagtagttgattgtaatttagttattattggtagtggtagtgatattaatttagtatattataattaatatttaaaagaataaattaatgggtattataaaaagtaagggtaaatattgttgtataaaatgtttgtttgtattatatataggttgaattttataaaattgttattttataggttaagaaggtgggatattgttaattttttataatttagtgtatgtgtgtaatggatgataatattaattgtattttttattgtgagttataatttaaaagtttgaaaaatattgaaataaaatatgtgtaagtgattagtaaaatatagtgtgtattttgtgtgtatagtgaataaaatatagtgtgtattttttgttatatagagataaggtttttttatgttgtttaggttggttttaaatttttgggtttaagcgatttttttatttcggttttttaaagtgttgggattaaaggtttgagttattgtatttagtttttaatagttttaaagaggttttttttttttttattaatttattttttataataggtatttaaatatatggaacgtgttagtttaagaggaagaataggttaaatagataaataggttttagaagggttttagggattataaatgatgtttggggttatgttttgtttgagtattataatattatagttaaagttttgggattttatttttatttgttttttaaagatttttttatttgcgttttttagtttagatatatgtaggggtgatattttttagtagggataattgttttttgttatatttataggggagggtgtttgggaagaacgtagtttttagtttttttttaaataggttgttttttttttaattttttttaatttttgggttattgtatattagtgttagtgttatagtttttttgtttgtttgggatggtttatttttatgttttttgttattatagggagttaggaggagatttttatttatattattggattattgtaggttttagagttaaaagtattgttagggataaagttaaaattaaaaattgttttatagaggtgttttatttggattttataatatttaaaaattataagagtttatataaaaatttgaatgtttggtcgggcgtggtggtttatgtttgtaattttagtattttgggaagttaaggtggatggattatttgaggttaggagtttaagattagtttggttaatatggtgaaacgttatttttattaaaaaaataaaaaagtagtcgggtatagtggtatatatttgtaattttagttatacgagaggttgaggtaggagaattatttgaatttgggaggtagaggttgtagtgagtttaaatggggttattgtatttcggtttgagttacggagtgagatttttttttaaaaaaaaaaaaaaatttgaatatttgattttttttaaaaaaattagaatttttggtaatattgggtttaggtatttataaaagtattataatttggagttgatggtggttatagaagaggttttttattttattatagattttacgtagtttattgagtttaggtaagtttttgtttggttgttttgaaatgtgaagttgaaatgttttttcgaaaaggtttgattagagtagtattttgtaatagatgggagtttatgtttattttagattatgaagggtttttgtaagtgtatgggaattttagttagattttttatattatatagattttattttgattttttttttttttttttgatttttattatttaattaataataaataaaaattaaggattgtttttaaaaattattgttatggttgggtgtagtgatttatatttaaaattttagtattttttgaggttaaggtgggaggataatttgagttcgggagttttgatattagtttggataatataatgagattttattttttaaaaaaaaaaaatataggtaggtaaggtgggttatgtttgtaattttagtattttgggaggtttaggagggtggattatttgaggttaggagtttaagattagtttggttaatatggtaaaaattttattttttttaaaaatataaaaattagtcgggtttggtggtgtatgtttataattttagttatttaggaggttgaggtaggagaattatttgaatttggaggggagagattgtagtgagttaagatcgtgttattttattttagtttgggtgaaagagtgaaattttattttaaaaaaaaaaaaaaatgttggggtatagtggtacgtatttgtagtcgtagttttagttattagggaggttgaggtgggaagattgtttgagtttaggttgtagtgagttatgatggtattattgtatttaatttaggtaagaggaaaattttgttttaaaaaagaaaaaaaaattattgttaaaatattttaaatttgtttttatttggaattaatttttatttagggatttataattttgtatagaggtaaagagggtattaattgtgatggtagtattagtagtaatggaaaagaatttatgagttattgtgtttaggaaaagtttggaaagttatattttaaatattaatagtgtttatttatggagagtgaggtttgggatgagaggggtgtgtttttttgttttatataagtttgtattatgtgatttttttgataattaatatgatttttatattttttttttaaaattaagtaaaaataggtcgggtgcggtggtttatgtttgtaattttagtattttgggaggttgaggcggatggatcgtttaaggttaggagtttgagattatattggttaatatggtgaaattttgtttttattgaaaatataaaaaaaattagttgggtgtggtggcgggtatttataattttagtttttggggagtttgaggtaggagaatcgtttgaatttaggaggtggaggttgtagtgagt

SEQ ID NO: 149 - DNA, 5512 bp, Artificial Sequence
  chemically treated genomic DNA (Homo sapiens)
ggttaggttggttttaaatttttgattttaggtgatttatttgttttagttttttaaagtgttaggattataggtttgagttatcgtatcgggtttgtgattgggttttaatagaaattttagtagtgggttttgttatttttttataagtgaggatgtttagatttaagaggtagatttatttatttaagattttatagtagagttagggtttgtattaggattttatgattttaaagtttttgtgtttttttttaggttatattaattttaggaaagatgaggttaattttattaggtggttaagggaggaatgatattttaggtagatggaatgaaaggggttagtgtttggagttgagaggttagcgtaaggggaaaagtttggtcgaagtatttttttgaggtttggagtaaggaagatgtgggtagatttgagatttaagaaacgaagaaataatgagaaatagattttatagaaaggaattttttttagttataataaaggaaagtggtagagtattgggaggtgtcgtggaagatgtttagttttttcgtatataatttttagagggtttgaggttgggtattgggttggttaaggtataaaagattttttgttgggttggaaggaggagaaattagtttagcgggaagagcggtttgatagttattatggatgaggatgagaagttaggtttgatttagggttgtttaggatagtgttaattttatttagttgtttggttttgtgtgtttttttttttttttttaggtttttgggtttggttttgtaatgagggggttgtaaagggtgggttttttttgtttatttgattggttgggaaatgtgaatttggtatagattttgtattttttttttttcgtttagaaagaaatcggtttataagttttttttttagggtaggtaggttgggtagttgggtagaggaagtaggattttttttttatttattttgtttagttttatatttttttttttatgttatttttagaaatagaggatagttattatgttttaggtaggatggttttgtgtttttttggtgattttattgtaaagtgatttttttgaagagtggtggataggggatagcggtaggaacgggttttatttaagtttcggtagttttttttttttttttagatttgtatagaagtttttattttgtgtatataaatatatattttttttaggttttgatttgtttttttggataagaatgggggtggtatttttatagggaggtattagggtttggttttagaggtggggtatattttgagtatgggtttatggttttatttttagaagtttttttcggtgggggttggagtgtaggtaggttgtttaagtagaggtaaggtgggggtgaaataggatgtttaagtgttttagggttttttttttttgtcgtagggtgaaaagatattttttagaaagtttttagtttttttgggaaggttttttatttttattttattttttttttggtttttatgtaataggaattttttttgaagaagggatttggagtataggaaataaaggtatttttgtattatttttttttattttttaaggaaggttaagttaaggtgattttaatttgttttttttagggtaggggtatgggtagatttgatcgttaagggtaaggtagaaaggggatttgggataattttttttttttttttttttttttttttttttttttgtgacggagtttcgtttttgttgtttaggttggagtgtaacggcgtgattttagttaattgtaatttttatttttttggtttaagtgattattttgttttagcgtattgagtagttgggattataggtgtgtattattacgtttagttaatttttggatttttagtagagacggggttttattatattggttaggttgatttcgaatttttgattttaggtgatgtattcgttttagttttttaaagtgttgggattataggcgtgagttattatgttcggttttttgggataatttttttaatttataaatttaaatttatttttatgtaagtgtgtatagagtatattgttttatttaatagagtaggggtgtaggttgggcgagaatggagatgttatgtttcgtatcgtagaaaaatggtgggttagtttagtttagggaggtttttttatttcgtcggtgtgtgttgggtttggggaagtttagaaaggttatattgagattttgtttataaggttcggtaatttggattttggtgttatttgtgtatttattggttagatagttttgggtaggttttttttatggattaattaaagggtgtgattttggttttgattgtttttaaggttattgaaaggattcgttgagttgaagagtataattatgtttgtatataaatgtgttttgatgtagtttaggatacgaatatagtgtgttaattgaagtttaggttgtagattattattatttttaataaaatataggaggtttttttttggagaatatattgttttttttttttttttttttttttttttgagatagagtttgattttgttgtttaggttggagtgtagtggtatgatttcggtttattgtaattttcgttttttgtgtttaagagatttttgtgttttagtttttcgagtagttgggattataggtgcgtgatattacgtttagttaattgttttgtatttttagtagatacgaggttttattatgttggttagattggttttaaatttttggttttaagtgatttttttattttagttttttagagtgttgggattataggcgtgagttattgtatttagtttggggaatatatttttgtaagatttttaaaatttttttttattttttatttaatattgtgatttggatttgggggtgaagagtagttaggggtaaggaggttagtttcggatcgtagtttagttagatttttgatagtttttgatttttttgaatttttatttcgtggttttagtttttttttttatagtttggttttttaaaattattagggtattttgtggtgggaaattatttatataaggggataaataaggggattgaaagtaaaaagaaattttaaatttgatatttttgggtagttgtgttatttggagttacgattatagttatttttttttaatttaattttgatatttttttttttatttttttgggtgttttttgtttattttgggaaagttttatagtttttttttttttttattgtattttaaagggagaataggtttgaagaaatggagagaaatttagatagaattagagaattagatggagatttaaggagataagggagagatatagagagaataaaagttagagtgggggtcgggtatggtagttgatgtttgtaattttagtattttgggaggtcgaggcgggtggattatttgaggtcgggagttcgagattagtttgattaatatggagaaatatcgtttttattaaaaatataaaattagaaatataaaattagttaggagtggtggtatatgtttgtaattttagttattcgggaggttgaggtaggagaatcgtttgaattttggaggtggaggttgttgtgagttaagatcgcgttattgtattttagtttgggtaacgagagcgaaattttattttaaaaaaaaaaaaaaaaaaaaaatttagaaggggaaatgtgtaatgaaagatatagatattcggggttttatagttagagattaaatgagggatggttaattaagggtatagttattgggtatagggttagggtgggaggtacgggagggttttgaaaatatagttatatatttttttaggtttattttttttattttgtattttggtattttaatgttagttttttaggatttaggattatttatattaaagttaagttcggtttaattaagatagatgtttggtgggtggggttgtttgttggagtaataggtttttgtaggttttggaggagaagtttagagaggtggttgtttggaagagagtaggtaggatttttttttttaagtaggtatttttattttattaggtgtttagatgttagtgtatggtaagggtggttttttgttttttagatttgggtgagaggatttgaaaatttgaggaatttgtttttattaattgatttttatatttgtttgaagggaattgttggagggtataggtgttaagtgggatttatttaaatgtggtaatgggtttgtatttagttatcgataggttgtatgacggtggtaaagttattttttttttttggtttttgtttttttatttgtaaaattatttttatggttatttttagttgtggtatttggtttttattttagttgattttttagttttgtgtttgatttttttttgttaaatttattgtttagagtgggaaaggagaggagagggattatatttttttttttttggggttttttgtagagtatttgggaagtaaggtttttttatattttttatgtatttttttagagtttttaattttttttttcgtgattttgttaattaagatattgtgattatatagagaaggtggggagaacgtagatattttggtttttgtagttttgaagtttttttttttttttttttttgaagttaaaagaatgaaattgggagaggtagtaaggggtaagaaaggagagtggaaatggagagaaaagggtagttttgagaagtagttggggagggaggtagatgagaatgtattttttttaatagaatatgtagttttggtttagttgtgttgtgagtgggtagttgggttggttttttttttggtgttgttaattcgttgttaggtagaggggaggtttagaggagagggaagttgggtaaaggggatggaaggcgtttagttcgattttattaaattttttgggtttcgtgggaaggggttttttggagagggggattgaggttttagataggatatttattgttgtggtaaggtttgtagagagtttcgaagttaggaggatttaagacggtttttttttggatttttttgaaggtagaattagttttataagtaattaggttgggtgaacgggggcgttggttagtttatggattatagtcggttggtgaggttacgtgtttattgtgtggttttgggtggtttcgggtaagttttttttttttttaggatttttattttttatttgtaaaattgtggagagggggagggttgaaatatatgattgttaagattttttttagttttttcgttagggttgagtttagatggtcggagtaaaagaaggagggaggtgttgcggtggtgggggtgattttggttttattagaatttttagttttttttttttttatagttttgtttttgaggttataaaatttgtggtttttaagatatatatgcgtatatacgcgcgtgtatatatatattttatatatttattttttaatttagg

SEQ ID NO: 150 - DNA, 5512 bp, Artificial Sequence
  chemically treated genomic DNA (Homo sapiens)
tttagattaaaaaataaatgtgtggggtgtgtgtgtgtacgcgcgtgtgtgcgtatgtgtgttttgggggttataggttttgtgattttagagataaaattgtagagaggggaagaattggggattttagtgaagttaagattatttttattatcgtagtattttttttttttttttatttcggttatttaaatttaattttgacggaggaattggaaagaattttggtagttatgtgttttagttttttttttttttataattttgtaggtaagaaatggaagttttgagagggaaaggggtttgttcggggttatttagggttatatagtaggtacgtggttttattagtcgattgtgatttataaattagttagcgttttcgtttatttagtttagttatttatgaggttggttttatttttagaaaagtttagggagggatcgttttgagtttttttaatttcgaaattttttataggttttgttatagtagtgaatattttgtttagagttttagtttttttttttaagaggtttttttttacgaggtttaaggggtttggtaaggtcgggttggacgttttttattttttttgtttagttttttttttttttgggttttttttttgtttggtagcgggttggtagtattagaggaggggttagtttagttgtttatttatagtatagttgggttaagattgtatgttttgttggggggggtgtatttttatttgtttttttttttagttgttttttagagttgtttttttttttttatttttattttttttttttgttttttattattttttttagttttatttttttaattttagaggaaaaaaaaaaaaagaattttaaagttgtagaagttaaaatgtttgcgttttttttattttttttgtgtggttatagtgttttagttggtaggattacgaggaaaggaattgaaaattttaagggggtgtatggaggatgtagggaagttttgttttttagatgttttgtagggggttttagggaggaggaagtatagttttttttttttttttttttattttgagtaatggatttggtaggggagggttagatatagagttagggggttaattggaatgaaagttaagtgttatagttggaagtgattataaagatgattttataagtggaaaaataaaggttagagaggggaagtgattttgttatcgttatgtagtttgtcggtggttggatataaatttattgttatatttgggtgggttttatttggtatttgtgttttttagtagttttttttaggtaggtgtggaagttagttgatgggagtagattttttaggtttttaagtttttttatttaggtttggagggtagagggttatttttgttatgtattgatatttgggtatttgatggggtgggggtgtttgtttaagagagggggttttgtttgtttttttttaggtagttatttttttagattttttttttagggtttgtagaggtttgttgttttagtaggtagttttatttattaaatatttgttttggttgggtcgggtttggttttagtgtgggtagttttaggttttaaaaagttagtattgaggtgttagagtatagaatgggaaggatgggtttaaaagggtgtgtggttgtgtttttagagttttttcgtgttttttattttgattttgtgtttagtggttgtgtttttggttgattattttttatttggtttttgattgtaaggtttcgaatatttgtgttttttattgtatatttttttttttgggttttttttttttttttttttttgagatggagtttcgttttcgttgtttagattggagtgtaatggcgcgattttggtttatagtaatttttatttttaaggtttaagcgatttttttattttagtttttcgagtagttgggattataggtatgtgttattatttttggttaattttgtatttttaattttgtatttttagtagaggcggtgtttttttatgttggttaggttggtttcgaattttcgattttaggtgatttattcgtttcggttttttaaagtgttggaattataggtattagttattatgttcggtttttattttggtttttattttttttgtgttttttttttgtttttttaggtttttatttggttttttgattttgtttgggtttttttttatttttttaggtttgttttttttttgagatgtagtggggaggaggaggagttatggaatttttttaggatgggtaaagggtatttaagggagtagagggaagggtgttagagttgggttgggaagaggtgattgtagtcgtggttttagataatataattatttagaaatgttaaatttggggtttttttttgtttttagtttttttgtttgtttttttgtgtgggtgattttttattataaagtgttttggtgattttggggaattaggttgtggaggagaaaattgaggttacgggatgggggtttaggaagattagaaattgttaagggtttgattgagttgcggttcgaggttggtttttttgtttttaattgttttttatttttaaatttaagttatagtattagatggggagtgaggaaggattttagaaattttatagaaatatattttttaggttaggtgtagtggtttacgtttgtaattttagtattttgggaggttgaggtgggaggattatttgaggttaggagtttgagattagtttgattaatatggtgaaatttcgtgtttattaaaaatataaaataattagttgggcgtggtgttacgtatttgtaattttagttattcgggaggttgaggtataagaattttttgaatataggaggcggaggttgtagtgagtcgagattatattattgtattttagtttgggtaatagagttagattttgttttaaaaaaaaagaaaagaaaaaaaaaaaagtaatatattttttaaaagaagattttttatattttattaggaataataatagtttgtagtttaggttttagttggtatattatattcgtattttgaattatattaaggtatatttgtgtatagatatggttgtgttttttaatttaacggatttttttaataattttgaaggtagttagggttagaattatattttttgattagtttatgaaagaaatttgtttaaagttgtttggttagtaagtgtatagatggtattaggatttaagttgtcgggttttgtgggtagggttttagtataatttttttaagtttttttaagtttagtatatatcggcggagtgaagaggtttttttgggttgggttagtttattatttttttgcggtgcggagtatggtatttttattttcgtttagtttatatttttgttttattgaatgggatagtgtgttttgtgtatatttatatgaaggtgggtttgagtttatggattaagagaattattttaaagggtcgggtatggtggtttacgtttgtagttttagtattttgggaggttgaggcgggtgtattatttgaggttaggagttcgagattagtttggttaatatggtgaaatttcgtttttattaaaaatttaaaaattagttgggcgtggtggtgtatatttgtagttttagttatttagtacgttgaggtaggataattatttgaattagggaggtggaggttgtagttagttgagattacgtcgttgtattttagtttgggtaataaaagcgaaatttcgttataaaaagaaaaaaaaaaaaagagggagagagaaagaattattttaggttttttttttgttttgtttttgacgattaggtttgtttatgtttttattttggggagaatagattgaggttattttgatttgattttttttggggggtggagggaggtggtatagagatgtttttgttttttgtgttttaagttttttttttaaggagagtttttgttatatgggagttagaggggaggtggggtaggggtgaagggtttttttaagaaagttggaggttttttaggaagtatttttttattttgcggtaaaggggagaagttttggagtatttaaatattttgttttatttttattttgtttttgtttggatagtttatttgtattttagtttttatcggagaaggtttttagaagtggggttatgggtttatgtttagagtatattttatttttgaggttaggttttggtatttttttatagaaatgttatttttatttttgtttaagaagatagattaggatttagggagggtgtgtgtttatatgtatagggtgaggatttttgtgtaaatttgggggaagggaaggagttgtcggagtttgggtgaagttcgtttttgtcgttgttttttatttattattttttagggaagttattttatagtgaagttattaagagaatataaggttattttgtttgaggtatagtgattgttttttgtttttgggaatagtatgaggggaagggtgtggggttggatagggtgggtaggagaggagttttgttttttttgtttagttgtttagtttgtttgttttgggggagaggtttgtaggtcggtttttttttggacgaagagaagaggatgtagagtttgtgttaggtttatattttttagttagttaggtgggtaggaggagtttattttttgtagtttttttattgtagggttaggtttaggagtttggagagaggagagagggtatatagagttaggtagttgagtggaattggtattgttttgggtagttttgggttaagtttggttttttatttttatttatgatgattattaggtcgtttttttcgttgagttagttttttttttttttagtttaataagaaattttttgtgttttggttagtttagtatttaattttaagttttttgggggttgtgtgcgagggggttgagtattttttacgatattttttagtattttgttatttttttttgttatgattggagggggtttttttttgtagaatttgttttttattgttttttcgttttttaagttttagatttatttatattttttttgttttaagttttaaaaaagtgtttcggttaggtttttttttttacgttggttttttaattttaagtattagttttttttattttatttatttggaatgttattttttttttggttatttggtgaaattggttttattttttttagggttagtgtggtttagaggaaaatataaaggttttggagttataaggttttggtgtagattttggttttgttgtaggattttgagtgagtgagtttgttttttggatttaagtatttttatttgtaaagaaatagtaagatttattgttgggatttttgttaagatttagttataggttcggtgcggtggtttaagtttgtaattttagtattttgggaggttgaggtaggtggattatttgaggttaggagtttgaggttagtttgatt

SEQ ID NO: 151 - DNA, 6327 bp, Artificial Sequence
  chemically treated genomic DNA (Homo sapiens)
tttttttttgttaatgtgttatttttagtagcgataatataaatagagaatttatgtatatttatgtttttggcgtttttatttgatttttttttaatttagttatttttagtttgggatatataatttttatttatttaggaatatagagatagaatttaggggtgttatgaatttggatggagaaaaattatatttttatttttattaattttttatttaagtatagcgttttttttatttatgaatgtgggtaataaattgtagtagtattagtcgtggtggtgaatttgttattaatagaaattatagatgtatgtattttatgttatagatgttgtagattttttgaaaatattatttatatattattttttagagattatcgtaataagtttagttatttaatgtgttaaatatgaagtatatgtattgttatattgtattttaagttattttaataattattaaatatagttggttgttttttgtgtttatgtattttaatttatggatttaaaataattattttgaaatgagaattaaagtttttttattttatatatttaaaattattgttttgaaaataaatttgtttttaggtttttttagattgttaaaaggtttatggtataaaaaaggttatgaattttgattcggtaggagtttttaatggtgatataaatgtattaatatttaggtttgggatataggttgtattattgattttttgtgtggtttaaatgttttacgtttgttttgttatttattaaatgttttttgattttgtggtatttagtgtatttttttttttagtttttatattattttgagattacgattagtagtaattattttttgcgattggaaaaatattaaatgtagtgtttttttagtttgttaaattattgatttttattttttttgtggagaaggagaggaatatatttgaggataaattaataaggaatgattaagtattttttaggatggtagattatattttagaagttagtgttttttgttttttgttttgtttgtttgtttttttttttgtttgtttttagtataataggatagagtttttttagaaaagaatattatcgttagtttattttgtttaattttttttttttttagtttgaaaaagatttttttatgggattatggttgatttagtgaatgagttaaattttgttgtgataagagaagtatgaatgtaattttgtttttgtaattttagttagtgttagtgtggataaaattggatagttttttattttaaaatttttttgatttaggtttaaatttttatattttaggtatatatttgggtatagttttgataatatttaaatttttattgtagaattaaaggttagattatttagaaatgatttaggttagataaaaggtaatgtggtttggtatggtggtttacgtttgtaattttagtattttgggagtttaatgtaggtggatcgtttgaggttaggagtttgagtttagtttggttaatatggtgaaaatttatttttattaaaaatataaaaattagttggttgtggtggcgggtatttgtaattttagttatttgggaggttgaggtaggagaattatttgaatttgtgtgacgaagttgtagtgagtcgagattgtgttacgggaggttaaggttgtagtgggtattaagattggttattgtattttagtttgggtgataggagtaaaatttcgttaaaaaaaaaaaaaatggaaatgggtggggtattgtagtatttttgagttgaatgaggttttggggattatttggtttattttttttagttttggaaggagatttggtttgtttgggaattcgttagaatgtttggttagttgttgtttttttgtttttgtagtcgtaatgttttttttatacgttaatataattagttagttttttaatatttagtagtaagtataatatttggttcgtagtgttagtaaatgttggttttaaagtttggagtgtatagtattgtaattggtttatgggtttaattaggaatgtttttacggagagaggatgtgggtgtaagaggatagtgcggggagtcggaagttatgtggtgatttcgggttgcggtgtttttagtttattatgaatttttagtatagtattggattttttaatttagatataagtaggaaaggtaataagaaaggaattaggatggggaaatgtttcggggggtatagagatgattgaaaaatgtagttggtgtagtggttcgtttgtaattttagttttttgggagattgaggcgggtagattatgaggttaggagattgaaattattttggttaatatggtgaaaatttttttttattaaaaatataaaaaaattagttgggtttagtggcgtgtgtttatagttttagttattagggaggttgaggtaggagaattatttgaatttaggaggtagaggttgtagcgagttgagatcgtgttattgtattttagtttggcgatagagcgaaattttgttttaaaaaaaaaaaaaaaaaagattttatatatgtatatataaaataatattaaaaaaagaataaaatattataagttttttttttttttttttttttaatttattgtttttttttaatgaattattgttgatagtttggtttgaatttttttaggtttttgttttatatatatatatatatatatatatatatatatatatatatatatatttatatatttttgtaaagtgaattaaaagagtatataaataaagttaagattttttttaatgtatataatttttttattaggaagaaaatgataaattataatatttattttttattgttttatttttaaagataataattgtaattattaattttttttttttttttgagatagtttcgttttgtcgtttaggttggagtgtaatgacgcgatttcgatttattgtaatttttattttttgggtttaagtgatttttttgttttaattttttgattggttttgattataggcgtgcgttattacgttttgttaatttttgtatttttagtagagatggaattttatcgtgttggttaggttggtcgtgaatttttgattttaggtgatttgttatttttttttttttcgatttggttttttaaagcgttgggattacgggtgtgagttattgagtttcgttaattattaaatatttattgagtttttaatatgtattagatattgagttaaggtgttttatgtgtattattttatgtgtttttataatgatgtagtatttttgtattgatttttatttatgaggtatttgaaatatagagaggttaagtagattgttcgttatatagttagggtgagtataattaatagttaaatcggggttttggttttggagtttgtgtttttgattattatgtatatggttttattgatggttgagttacgtgaagatttttgtagagttagggtttggaaagggaagattttatttgttgtttaaagaaataggtaagtagagagtggggaggaaatttaaggaatagaaaatgataatgtgcgaaagtgtagagttgggaatatttatgagttttcggaggaattagaaagggtttagtgtttagaggagttgagcgtggagtaggtagtagattaatagtagtaagttaagaatattaaattgtttggggttagatttgggtttgtttgttagtgttttttaagtgtttttattagtatatgttaatttaagttatttgaaaaaagggatttttgtttttaagagtgaaaaatgtttgtataatgttcggtagtatgtgatgataaattatttttttagatttggaaaggttatttaatgtagttttaaagaggtttaagtattttttatagaatttacgttaaattattatttttatttgttttttgtttttttatttttgcgagattaaatatttttatttttgttttttatatattagggttttaagattttttattattttgtttttgtttttttaaatatagtttagtttggatattttagtttttatagagaggggttgaattttttaggtgaggtttgttagttaataagagagttgtattgttttttttattttaaattttattttattaacgaaatttataattattttttttttttattttattttgataatatattgttgatttatatttaattttttgttggtggtcgggtatcgtgatttacgtttgtaattttagtattttgggaggtcgaggcgggtggattatttgagattaggagtttaagattaggttggttaatatggtgaaattttatttttattaaaaatataaaaattagttaggcgtggtggtaggcgtttatagttttagttatttcggagattgaggtaggagaatcgtttaaattcgggagttggaggttgtagtgagttgagatggtgttatggtattttagtttgggtgatagagtgagattttattttaaaaaaagaaaaaaataaaaaataaaaaataaattttttattggttaaatatatgttgtatttatatataaatttaattaatattgtatttgattttgaataattaggaagagttggttataaaggaagaaataggagtattgggataaagtaattttttaattggaggttttaaaatagttagagagaaaaagttgaagggtgttgtttttatttttttttgttgtttttaagttaaaaaaagaaattatgtataatttatagcgttattgatgtttcgaaaggtgagaggtatatgtttgtgtttttgtggggttgtttttttttttaaaaatttgaaaatgaggaaatgaatttcgtaagttttgagtcgagaaaatttaatattttaggtttttggtaggatatgtgatattaattaggttttttataagatattggttttgagggttttttttttttttattttaggaatttaaatatgattaggaagatttttataaatattagggagcggtggaggtagtagaatgttaatagcgtttttgttaagttgaggaagtttatttttatttattttttagataaaaagttgagtaaaaatgaaacgtttcgtttggtaatgaggtatattaattttttggttaaggttttgggggagtaaagtttgtaataaacgggagtggttgtttaggggaatattttggggttttttttttaaggattttatttgttaggtttggaggatagaattttgtttgagaattattaggtttttttatttggtttaagttattatattttttagtgtggttttggttgttattttttagggtagtatttgtttagaaattattgtttgtggatagatttttgtatgttttagagttgatttgatgataattcgtgaagtatgaattttagttttttgggaggtggtttagagatagttgtagggagttgaaagaagttatgaggaatgttatttgtgggtcgttattttttagggatgttaggtagagcggtttatttttgtttattttaaatttaggttttgtataagatttttggagaaaaaattttaaataaaaaaaaaaaaaggttgaaaattattgtttatatttaatgtttttagttataagaaagaagtttttttataatggattttagatgaataagtagaatatgttttttttagaatatattttaaagtttgttttgaaaaatgagatttgattaagggtgaataaaataaattttaagattgatgggtcgggtacggtggtttacgtttgtaattttagtattttgggaggttgagatgggtagattatttgaggttaggagtttgagattagtttggttaatatggtgaaatttcgtttttattataaatataaaaatgagttaggtgtggtagtgcgtatttgtaattttagatatttaggaggttgaggtacgagaatcgtttgaattcgggagggggaggttgtagtgatttaagattatgttattgtattttagtttgggtaacggagtaagattcgtttttaaaaataataataataaaaaaagtttttttataatggattttagatgaatgagtagtagtatatgttttttttagaatagattttaaagatggttttgaaaaatgagatgtatttgattaaaggtgaataaaataaattttaagattgatgaatagaaagataatttttgtagaaattaatttgggagatttgcgggaaaaatttgtggagaaaagatatttttcgtttttcgtttattaaggtgtggggattata

SEQ ID NO: 152 - DNA, 6327 bp, Artificial Sequence
  chemically treated genomic DNA (Homo sapiens)
tgtaatttttatattttagtgggcggggggcggggggtgttttttttttatagatttttttcgtaagttttttaggttggtttttgtaggggttatttttttatttattaattttaagatttattttgtttatttttgattaaatgtattttattttttaaaattatttttaaaatttgttttgagggaagtatatgttgttatttatttatttgagatttattatgagaaaattttttttgttattgttgtttttgagagcgagttttgtttcgttgtttaggttggagtgtagtggtatgattttgggttattgtaatttttttttttcgggtttaagcgattttcgtgttttagttttttgagtatttgggattataggtgcgtattattatatttggtttatttttgtatttgtagtagagacggagttttattatgttggttaggttggttttaaatttttgattttaggtgatttgtttattttagttttttaaagtgttgggattataggcgtgagttatcgtgttcggtttattaattttaagatttattttgtttatttttgattaaattttattttttaaaataaattttaaaatatgttttgaaggaagtatattttatttatttatttgagatttattatgagaaaattttttttttataattgaagatattgagtataaatagtgatttttagtttttttttttttttatttagaattttttttttaaaagttttatgtagaatttggatttaaaataggtagaggtaggtcgttttatttgatatttttggggggtggcggtttataagtgatattttttatggttttttttagttttttgtagttgtttttgagttattttttaggaagttagaatttatgttttacgagttattattaggttaattttggaatatgtaaaagtttgtttataggtagtgatttttgggtaagtgttgttttgggagatgatagttagagttatattaaggaatgtggtggtttggattaggtgaaggaatttggtagtttttaagtagagttttgttttttaggtttggtaggtggggtttttgagggaagagttttagaatgtttttttgagtagttattttcgtttgttgtaggttttgtttttttaagattttgattaagaagttgatatattttattgttaggcgaagcgttttatttttgtttagttttttgtttggagggtgagtggggatgagtttttttagtttggtaaaggcgttgttgatattttgttgtttttatcgttttttggtatttgtgaagatttttttggttatgtttgagtttttgagatggaaagagaaagggtttttagggttaatattttataagaggtttgattggtattatatgttttgttaagaatttgagatgttagattttttcgatttagagtttacgagatttatttttttatttttaggtttttaaaaaagaaaataattttatagggatataaatatatgttttttatttttcgaggtattagtgacgttatgaattatgtataatttttttttttaatttaaaaataataggggaaggtaagaataatattttttagttttttttttttggttgttttgaagtttttagttgaaagattgttttgttttaatatttttgtttttttttttataattaattttttttaattgtttagaattaggtataatattgattgagtttatgtataaatgtaatatatgtttggttaatagaaagtttgttttttgttttttgtttttttttttttttgagatggagttttattttgttatttagattggagtgttatggtattattttagtttattgtaatttttagttttcgggtttgagcgatttttttgttttagttttcggagtagttgggattataggcgtttgttattacgtttggttagtttttatatttttagtagagatggggttttattatgttggttagtttggttttaaatttttgattttaggtgatttattcgtttcggttttttaaagtgttgggattgtaagcgtgagttacgatgttcggttattaatagagagttgaatatgaattaataatgtattattagaatgaagtaaaaaaagaaaatgattgtaggtttcgttaataaaataaaatttggaatagagaagataatatagtttttttgttagttggtagattttatttggaggatttagtttttttttgtaagaattaaaatatttagattggattatatttagaggagtaggaatagaatgatgaagggttttgaaattttggtgtatgaagaatagaagtgggggtatttagtttcgtaaaaatgaaaagataaggggtaggtgggagtggtgatttggcgtggattttgtagaagatatttgggtttttttggggttgtattggatgatttttttaagtttaggagagtggtttattattatatattgtcgagtattatgtaggtattttttatttttagaggtaagagtttttttttttaagtggtttggattaatatgtgttaataggaatatttgggaggtattggtaaataagtttaagtttagttttaggtagtttgatgtttttggtttattgttattggtttgttgtttgttttacgtttagtttttttgggtattgggttttttttagttttttcgaagatttatgaatatttttaattttatattttcgtatattgttattttttgttttttgaattttttttttattttttatttatttatttttttaaatagtaggtgagattttttttttttaagttttgattttataggagtttttacgtaatttagttattagtggaattatatgtatggtggttaagagtataggttttaaggttagaatttcggtttggttgttggttatatttattttagttgtgtgacgagtaatttatttaatttttttgtgttttaaatgttttataagtaaagattagtataggagtattgtattattgtgaggatatatgaaatgatatatataaagtattttagtttagtgtttagtgtatattaaaggtttaataaatatttaatgattggcgggatttagtggtttatattcgtaattttagcgttttgggaggttaagtcggggggggggggggtggtagattatttgaggttaggagtttacgattagtttggttaatacggtgaaattttatttttattaaaaatgtaaaaattagtagggcgtggtggcgtacgtttgtagttagagttaattaggaggttgagatagaagaattatttgaatttaggaggtggaggttgtagtgagtcgagatcgcgttattgtattttagtttgggcgatagagcgagattgttttaaaaaaaaaaagaaaattaatgattgtaattattatttttaaaaataaaatagtgaaaaataaatgttgtaatttattattttttttttaatgaagaagttatatgtattagagaaggttttagttttgtttatgtgtttttttgatttattttataggaatatatgggtgtgtgtgtgtgtgtgtgtgtgtgtgtgtgtgtgtgtgtgtgtgtagagtaaaaatttggaaggatttaggttaaattgttaatagtggtttattgggagaggatagtagattgggagaagagaaaaaaaggagatttgtggtgttttattttttttttggtattgttttatgtgtatatatataaaattttttttttttttttttttgagatagagtttcgttttgtcgttaggttggagtgtagtggtacgattttagttcgttgtaatttttgttttttgggtttaagtgatttttttgttttagtttttttagtagttgggattataggtatacgttattgggtttagttaatttttttgtatttttagtagagaagggtttttattatgttggttaggatggttttaattttttgattttatgatttgttcgttttagttttttaaagggttgggattataggcgaattattgtattaattgtattttttaattatttttatgtttttcgggatatttttttattttagttttttttttgttgttttttttgtttgtgtttgggttggggagtttagtgttgtgttaagaatttatggtgaattggaagtatcgtagttcgaggttattatatggttttcggtttttcgtattgtttttttgtatttatatttttttttcgtggagatatttttagttggatttatggattaattataatattatgtattttaagttttgggattaatatttattgatattacgagttaggtattgtgtttgttgttgagtgttgaggagttggttgattgtattaacgtgtgagggaagtattgcgattgtaggagtagagaagtagtagttagttaggtattttagcgggtttttaggtaggttaggtttttttttaaaattgaaaggggtgggttaggtgatttttaggattttatttaatttagaaatgttataatgttttatttatttttattttttttttttttgacggagttttgtttttgttatttaggttggagtgtagtggttaattttggtgtttattgtaattttggtttttcgtggtatagtttcggtttattgtaatttcgttatataggtttaagtgatttttttgttttagttttttaagtagttgggattgtaggtgttcgttattatagttagttaatttttgtatttttagtagagatgagtttttattatgttggttaggttggatttaaatttttgattttaggcgatttatttgtattgggtttttaaagtgttgggattataggcgtgagttattatgttaggttatattgttttttatttaatttaagttatttttgaataatttgatttttggttttataatgaaaatttgagtgttgttagaattatatttaagtatatatttaaaatataaaagtttaaatttgaattaaggggattttaaggtagaaaattatttagttttgtttatattgatattggttgggattgtaggagtaaagttatatttatgttttttttattataatagggtttagtttatttattaagttaattatagttttatgggggggttttttttaagttgggaggaaaaaagattaggtaggataaattaacgatggtgtttttttttaagagggttttattttattgtattagaaatagataggaaaaaaaataaataaataaaataaaaaatagagaatattagtttttgaaatgtagtttgttattttaggaggtgtttaattattttttgttgatttatttttaagtgtgtttttttttttttttataggggaaatagaaattagtggtttaataagttggaaaagtattgtatttagtgtttttttagtcgtaaggagtgattgttgttaatcgtgattttagagtaatgtaagagttaaaaaaaaaaatatattagatgttatagaattagagaatatttgatagatggtaaaatagacgtgaagtatttaggttatatagggaattagtggtatagtttgtgttttaggtttggatattgatgtatttatgttattattgaggatttttgtcgggttagggtttataattttttttgtattatggattttttagtagtttggggaagtttagggatagatttgtttttagaataatgattttaaatatataaagtaaaaaggttttggtttttattttagaataattattttaagtttataaattaaaatatatagatatagaaaataattaattatatttagtagttattaaaataatttaaaatataatatagtaatatatgtgttttatatttaatatattaaataattagatttattacgataatttttaaaaagtggtatgtaaatgatgtttttaaaagatttgtaatatttgtgatatgaaatgtatgtatttatgatttttattggtgataaatttattattacggttaatattattatagtttattatttatatttataaataaaggaaacgttatgtttagatgaaaggttagtggaagtaaagatgtaatttttttttatttaaatttatagtatttttgaattttatttttatatttttgggtggatgggggttgtgtattttaggttaagaatgattaggttggaggaaagttaggtagaaacgttaggaatatggatatgtataaattttttgtttatattgtcgttattgaaggtaatatattagtagagaaaag

SEQ ID NO: 153 - DNA, 7934 bp, Artificial Sequence
  chemically treated genomic DNA (Homo sapiens)
agttgttgggttattgggtatatgtatgtttagttttagtagatattgttagttttttgaagtgtgttaatttgtatttttattagaaatgtatgagagtttcgattgttttatatttttgttaatatttggtattgttatttttttaagtttagttattttggtgattaaaattattgatttttataaaaattttgtgatgtattggtattgttataatttttattttatagataagggggttggggtttagtaaggagaagttatttattttagattacgtaggatgttagtagtaagtgggtaatagtaggtttgtgtgatttttttgtttttgtggttgtatgaattttttattttttttttttgagatagagttttattttggtatttaggttgaggtgtagtggttttatttcggtttattgtaatttttattttttggatttaggtgatttttttattttagttttttgagtagttgggattataggcgtatattattacgtttggttaatttttgtattttttgtagaaacggggtttcgttatgttgtttaggttggtttttaatttttgggttttagtgatttgtttgttttggttttttaaagtgttgagattataggtatgagttatagcgtttagtttgtatgaaattttaaagttagaatatttgagtgtgttaaataattttttatttttataattattttttatagcgtttatttttatttgatagtagaaatataatttggttattttttggtaaatttagttaagtaagtgtatgattatttagttattttagggaatatttagttgagtgttttgtttttttatttttatttaggggtatggttgtattttgtggaggttatgtggttatggtatggagtgggaagtgagggggttaaggttgtttggtttttggttatcgttatttttttttattgtttagggaggtaggtagattttatttttgttagttgtgggttgtcgtttttggtttttattgtgtttatagatgtttgtattcgtgttatggtttttggtttggattgtggttttagtgttttttttattaggtttattattatagaagtttttttttggttatttgtttttttttagtaattttatgttgttttagggttttataatatatgttaatgttttttgggatttttataaattaggtatgggtttgagatgtttttagggttttttgtttaggtatatttagttgttatttttatttgattgttattatatttttttattatggaagattatttagattttatttatagatagattttttttttttttagaatttttaaatttatttggggttttaatttttttttatttttgggttgaggggatgggagaatgagagagagtttttttttagagatttatattagaagttaatagtatgtagtgtttttttttttattttaagtttggtatatattttttttttaatttttttaatagaggaaggtgaggtttagagaggtgaagtaagttatttaagattatataatagaggtaggtggtttgattttagagtggttatgtttatttttgtattagaggattaagattgagagagttgatatatagtaggatgtagttaggggattttttattatgtggattgaatatttttagtttatatgttgttttatgggatggaatatatgtttaagtttatagtttgttttatggatgggtgtataagaaatggaatgagaattgaattttgggttgtaaagttttgtttgtttgtttattttgagatggatttttgttttgtcgtttaggttggagtgtagtggcgtgattttcgtttattgtagtttttattttttgggtttaagtaatttttttgttttagttttttaagtagttgggattataggcgtttattattatgtttggttaattttttttttttttttttttttttttgtatttttagtagagacggggttttattatgttggttaggttggttttaaatttttgattttaagtgatttttttgttttggtttttttaagtgttgagattataggcgtgagttattgcgtttagtcgagggtttcgttttagatgtattgatagggttgttttttataggaatttttttgtgaatgttttatagtaatgaagattttaatgaagatttaaaaaggaagattatttttggaattgaatttattataaaaattggatttttttatttggaatatttgaatttaaggttttagtttttttggaggtagtatgttgggaatagttgtaaattagaaaatgtttttgtatttgaggaatggggttaagattgattgtttgggttgtgatggtagatacgtagttggagttggagtgacggttgggaaagtttttttggttttgttttttttttttgtaggataaggggttttgaatattttttggtgtggagtatgtggagtgattggagtaagggtggagttttagtttttttagggttagttttggaaatataggtatttttgttttttatatttatatatgtatttatacgtattaaggggattttgtgggggttagttttttttgatttggggtgattattatggataaatgaatggagaggagttatttttagtttgttttatcgtgttatagttattttggttttttcgagtggaggtttgagagaaggtagggttgatttagaaagtatggcgttaaattagttatttttgacgaatatttttggtttttttttggtagtgttttattattgatattttattatataggtttatgtatttattttgggtttgaggattatttggagaattggtttaaagggtagaaaaatttgtttttagggagttattagattgagagtggatttaggaatttgtattttttttgagttaatttatttttaaagttaaaaaatttgaatatgtaatatatttatgtgaattgatatttaaaagatataaaggggtataaggtgaaaaattattttaatttattttttagtgatttagttttttttttttgaggtgattaattttttgtgtattttttttgagataatttatatatatagtattatatataagtaaatgaaatatgttttatttatttttttgagattgggttttattttattatttaggttggagtgtagtgatattattttggtttttcgtaatttttgttttttgggtttaggtgatttttttattttaatttttagagtagttgggattatacgtttatattattatatttatttaatttttgtttttttgtagagacggggttttattatgttgtttaggttggttttaaatttttgagtttaagtgatttgtttatttcggttttttaaagtgttgagattataggcgtgagtttttacgttcggttttaaaatttgttttaaaagtagatattttttggtgattttaataaagggggtttttagatatatttggaaaaatatatttttatttttatgttagattttgtgttgggttttcgggttgtgtgatttgatattgtatagttttgtttagaatgtttaaagagagttaataaggtattattttttatgttataggcggggagtaaaggggttttagtgggttttgtttaggaggtttgaagttagagttgttgagggtagggttgtgttgtaaagaaaatgtttgagagttgtaggcgttttattttttgttattagttgtggtatttggtagatattggataggtttgtagataaagatttggtaatttaaggagttgtttggtttttttgtttagttttattttagaggtattgtatatttttggtttttttagggggttttgtgtggaagtattttttgtttttttggtgttagggatattattacgtgtttgttggttaggcgagttcggcgtttagttttttaggatggggagagtaatgttttcgagtagaatagggtggggtttttagattatttttttttttttatagttggttttattttatcgattttattaaagtttttttgggagtattttagagaagagttacgtttaggtcgggttttggttgtttggtttacggcggaatttttagtattacgtttcgtacgtcgggtttaaagtatgtttagtgaaggagtaggtatttattgttagatggagttatttttttagatttggggtttttttataacgatggttatgtttggtatggaagtttttttagaagttaatagtaggaaataagggttaatagtatttaattgtggagtaaggtttaaattttagttttgttatttaatcgtttcgaatttgtttttttattgtagaggcgaaaaggttaatattattttatttcggagggttatcgtggagaatggaagttggataagttgtattagtttagtagtaaaatatatatatataagcgttttatttttattttattttattttaggaatgaatatatatattcgcgcgcgtatatatattttaggaatgaatatacgcgcgtatatatatacgtagttttttttaggagtgaatatatatatatacgtttcgttttgttgtttttaggaatatatatagagacgtatatattcgttcggttttgttttttttaggttttttaattggggttttttattcggtttagggtatcgttgtttgaaagatttttttaggttagtcggggttcggtatttagttgacgagatagcgcggcgtttttagagttggggagaggcgaaaattttttcggtttttcgatttttcggttagtcgttttcggtagttttttgtcgtttttcggtttgggttcgtttagtcgttttcggtttgtcgttaggcgatttcggcggttagtttagtcgcgatgtgacgtcgcgcgtttcggggttttcggcgtttgcgtttttttttataaagtagacgtcgcgtcgcgttgcgacgttgtagtggtttcgttttcggttttttttttttttcgttaacgtttttcggttttcgttagtttttcgtcggtcgtttttttaatatcgaatatcgtgagtagtcgtttattgaattggaaagggtcgtggttatcggattgcgtgtcggttggttttatcgttgcggtttgggtttgttcgcggcgggcggtgattgggtttggttttttttcgggttcggtggatcgcgttgtcgattttgtttttcgggagatattattaggtttcgtttatttgtttcgttttcgatttagcgaggttttttttggtcgggcgtttttacggcgttttataagtgagtcgaatttcgggttgggttttttttgtatcggtcgagcgttagtcggcgcggagttcggttgtaaggtttaggttgcggtcgggggttttttttggttttaagtttgttgtttcggggattagggcgggggtggcggcggggttgtgaatgggggttttttggttgtcgtgagcgtgggcgtgtgtcggtgtttggtttttgttgtggtcgggagggagagttgcggtggtggtttgaggtcgttcggtttttggtttttattttttttttatcgtgtttggcgttattagttatcggtcggttttggttaatcgtgtgcgggcgtcggttttttgtatatagtcgtttgttttatttgaatattttttagcgttgttttgttatgatttggagtcgttgagtagatattatcgttagagtggtgtgatttgtaggagttttaattgtgtataatttaattttaggtatttggtttttaaagaaataggacgtttatttgttttgatttatttttaatggaaattttacgtttgggttttagggatatgtattttttttttagagcgtgatagtagaatgtattcgttttatagaataatatcgttttttttattgtgtagtttaaaaagtagtgttagaatttcgggttatttaaagcgtaggggttttttttttatatgatgtgatagaattcgttttatgttggttatggagaattatttataagtgtaggagtttttaggtttttttttttagaatggaattgttttgaaagtattttaaataaatattttatttattattatttaaaaattttgtattttattttattgtaatattaaaatttatttttgagtttagtattattaagtgtatcgaattatagattaatcgattgattagttgttatttagtaaggttttaatttttttaagagtaatttaatttataaatttgattatgattaagtatttattttgagttatttgaaagaaatatgaaacggtcgttttgtttttagagtaattttaattaattgtattgttagatttgtgattttgtattgtttattttagtattatttaatataaaaattatatgtttaaatgttttataattaaaaattgggtttaggttaaaatatttttttttggagatattttttgttgtggttttgttataggaagggttttttattttgtatttttttttattaagtagggataattgtattattggtaagcgttaagtaatatggagaagtagatatgtttgtgaatcgtaaagtgaaatttgattttttttaattatggatgagtgagagtaggatattttagtggttggttttaaaatatgttttatttttttgttttttttgtttaataatttgtttgttttggggttggcgataattgttttagagaagttgaatgaatattttaatcgatgtaatgggttataagtttttgaatataaaatgggtgtgatgtatgttttaaatgttaaatgatatatttttgggaaaatatatgcgatttgtaatataatatatttagaaaattttagaggtgttataagttaatagtgatattatcggattatgaatatttgagaagtatgggttttttaaaagttgtatgtgagttttaagaggttttgaattaatttgtataaggtattgttattttttttgttgttgttgttttttttgtttgtatgtttttttttttaaaaaaagaatttgaagatggtaagaaattgttggatttttaattttaaatgtttttttttttttttttgttagaatttaagttttttgaaattaaatgtttaattttttatgtaagattatattttttttttaacgatttataattaatttgaattaataaatgcgtttttagagtaagtaaaaggttattattatggagattttgttaagagattttaaagttggttatttggatagttagtattgaaagataaaaagggttttgaaatgaagtttttaagtagatttagggaattgtatttatatttgtttatttttaaattattttatttttttgtatatggttttgtattgttttagatataaatgagtatattttgatgtattttttggatttgaatttatttttataggtaggatttattgtggggaaaatttttattttatttagtagcgttgtttgttttggattgattttttttaggttcgtatgtagttaattgtggtagttaattgtttagatggagtttagtatttagtgggagacgaaaggtaggtagaaagtaaatataaatatgtatgttttattaaatttatattaatagtgagtttagtagggtaggttttaaaagtttttgtttttagtagttatattttgaaaaaattttaatagaaatattcggagattaatttgtgaataattgtttataatagtgttttatagggttatgtattgtaggtttttagaattttgtggttaataagttagagttttttgatggattgtagttgatgaaatgttatgtagaatttttttttttaaattttatatttaatgttttttttttttaga

SEQ ID NO: 154 - DNA, 7934 bp, Artificial Sequence
  chemically treated genomic DNA (Homo sapiens)
tttaaaaaaaaaggatattaaatataaaatttaagagagagagttttatatgatattttattaattatagtttattagaaggttttaatttattgattataaagttttaagaatttataatatataattttgtaaagtattgttgtaagtagttatttataagttagttttcgagtatttttattaaaatttttttaaagtataattattaggaatagaagtttttaaggtttgttttattgaatttattattggtataaatttaataaaatatatatatttgtatttgttttttgtttgtttttcgttttttattgaatattggattttatttgaatagttaattgttataattaattatatgcgaatttgaggaaggttagtttaaaataaataacgttattaaataagatagaaattttttttatagtgagttttatttgtgaagatgagtttagatttaaagagtatattagaatatgtttatttatgtttgaggtaatgtaagattatatataagagaataaaatgatttaaagataagtagatgtgagtataattttttaaatttatttaaaagttttattttagagttttttttattttttagtattgattgtttaggtgattaattttgagattttttggtaagatttttataataataattttttatttgttttgaaaacgtatttattaatttagattaattatgagtcgttaggaaaaagatataattttatataaaaagttaagtatttaattttaaaggatttgagttttggtaaaaaaaaaaaaaaaggtatttaaaattaaaagtttaataattttttattatttttaaattttttttttaaaaaagaaaatatataaataaggaaaataataataataaaaagaatagtaatattttgtatagattaatttaaggttttttaaaatttatatataatttttaaaaggtttatgttttttaagtatttataattcggtgatgttattattaatttatggtatttttgaagttttttaggtgtgttgtattataaatcgtatatatttttttaaaagtgtattatttggtatttaaaatatgtattatatttattttatgtttaaagatttatgatttattatatcggttaaaatatttatttagtttttttgagataattgtcgttaattttaaagtaaataggttgttaggtaaaggaagtaaaaaagtaaagtatgttttaaaattagttattgaaatattttatttttatttatttatagttggagagaattagattttattttgcgatttataaatatgtttgtttttttatgttgtttagcgtttgttaataatgtagttgtttttgtttaatggagaaggatgtagagtagaggattttttttgtgataagattataataaaaggtatttttaaaagaaaatattttaatttgagtttaatttttaattataaaatatttaaatatgtaatttttatattagatagtattgaaatgaatagtgtagaattataaatttaataatgtagttgattaaaattattttaaaagtaagacgatcgttttatattttttttaaataatttaagataagtgtttagttatagttaagtttgtggattgggttatttttaagggagttgagattttattaaatagtagttggttaatcggttaatttgtaattcgatgtatttggtaatattaaatttaaagataagttttagtgttatagtagaataaagtgtaaaatttttaagtaataatggatgaaatatttatttgaaatgtttttaaaataattttattttaaagaaagaggtttaaaggtttttgtatttgtaaataattttttatggttagtataaagcgggttttattatattatatagaaaaaaaatttttgcgttttaagtgattcgaaattttgatattgttttttagattgtatagtggaggagacggtattgttttatgaaacggatatattttattgttacgttttaaaggaaaaatgtatgtttttaaaatttaaacgtgaagtttttattaaaagtgaattaaagtaggtagacgttttatttttttaaaagttagatatttagagttaagttatatatagttaaggtttttataagttatattattttgacgatggtatttgtttaacgattttaagttatggtaaaataacgttaagaaatatttagatggagtaggcggttatgtgtagaaagtcggcgttcgtatacggttagttaggatcgatcggtagttagtgacgttagatacggtggagaaaggatgggagttaagaatcgggcggttttagattattatcgtagttttttttttcgattataataaaagttagatatcgatatacgtttacgtttacgatagttaagggatttttatttataatttcgtcgttattttcgttttggttttcgggatagtaggtttaagattaagagaggttttcggtcgtagtttgggttttgtagtcgagtttcgcgtcggttgacgttcggtcggtgtagagaaggtttagttcggggttcggtttatttatggagcgtcgtgaggacgttcggttagaggaggtttcgttgagtcgggggcggggtaggtgaacggaatttggtagtgtttttcgaagaatagggtcgataacgcgatttatcgggttcgaaagaaggttaggtttagttatcgttcgtcgcgggtaggtttaaatcgtagcggtgaggttagtcggtacgtaattcggtagttacgattttttttagtttagtgggcggttatttacggtgttcggtgttaaggagacggtcggcgggaggttgacgagagtcgggaggcgttagcgaaggaagagaaaaatcgaagacgaagttattatagcgtcgtagcgcggcgcggcgtttgttttataggagagggcgtaggcgtcgaggatttcggggcgcgcggcgttatatcgcggttgggttggtcgtcgagatcgtttgacggtaggtcgagaacggttgggcgggtttaggtcgggaggcggtaaggagttgtcgggggcggttggtcgggggatcggggggtcggaagagttttcgtttttttttagttttgaaagcgtcgcgttgtttcgttaattgggtgtcggatttcgattggtttagaaaggttttttaggtagcggtgttttaagtcgagtgaaagattttagttaaaaagtttggaaaaaataaaatcgggcgagtgtgtgcgtttttgtgtgtgtttttgggaataatagaacggggcgtgtgtgtgtgtgtttatttttggggggggttgcgtgtgtgtgtacgcgcgtgtgtttatttttgaggtgtatgtgcgcgcgcgggtgtgtgtgtttatttttggggtggggtggggtgggggtggggcgtttgtgtgtgtgtgttttattattgaattgatatagtttgtttagtttttattttttacggtaatttttcgaggtgaaatagtgttagttttttcgtttttgtagtgagggaataggttcggaacggttaagtggtagagttaggatttgaattttattttataattaggtgttgttagtttttattttttattattgatttttaaagaggtttttatgttaaatatagttatcgttatagggaaattttaagtttagagagatggttttatttagtagtaggtatttatttttttattaaatatgttttgagttcgacgtgcgaggcgtggtgttggggatttcgtcgtgaattaggtagttagggttcggtttggacgtaatttttttttagggtgtttttaggaaggttttgatgaggtcgatggaatgaagttagttgtaaaggaaagggagtagtttgaaagttttattttgttttgttcgggaatattattttttttattttaggagattgggcgtcgggttcgtttagttaataggtacgtgatgatatttttgatattaggaagataaaagatatttttatatagggttttttgaagaaattagagatgtatagtgtttttgggatgggattgggtaggaaggttaagtagttttttgagttattaggtttttgtttataagtttatttagtgtttgttaggtgttatagttgatgatagaagatgaaacgtttgtagtttttagatattttttttgtagtatagttttgtttttagtagttttagttttaggttttttaggtagggtttattggagtttttttgtttttcgtttatggtatagaaggtggtattttattaattttttttaagtattttaagtaggattgtgtagtgttaggttatatagttcggggatttagtatagggtttggtataaaagtagggatatatttttttaaatatgtttgagaattttttttattagaattattaagaaatgtttgtttttaaaatagattttggggtcgggcgtggaggtttacgtttgtaattttagtattttgggaggtcgaggtgggtagattatttgaatttaggagtttgagattagtttgggtaatatggtgaaatttcgtttttataaaaaaataaaaattaggtgggtgtggtggtgtgagcgtgtagttttagttattttggaggttaaggtgggaggattatttgagtttaggaggtagaggttgcggagagttaagatggtgttattgtattttagtttgggtgatagagtgagatttagttttaaaaaaataaataaaatatattttatttgtttgtatatggtgttatatgtatagattattttaggaaagatatataagaaattggttattttagaggaagggaattaggttattgagggatgggttagaataattttttattttatatttttttgtattttttgggtattaatttatatgaatgtattatatatttaaattttttaattttaaaaataaattggtttaagaaaaatgtagatttttgggtttatttttaatttaataattttttgggggtaggtttttttgttttttaaattagttttttaggtgatttttaagtttagagtaagtgtataaatttgtgtagtagggtattagtggtgaagtattgttaggaaggagttaagagtgttcgttagaggtgattagtttagcgttatattttttggattaattttatttttttttaaatttttattcgggagggttaaggtagttgtagtacggtgggataggttgggagtgatttttttttatttatttatttatagtgattattttaggttagaaaggattggtttttatagagtttttttggtacgtgtggatatatgtgtgggtgtgaggagtaggggtatttatgtttttagagttggttttgaggaagttgaggttttatttttattttaattattttatatgttttatattaaggggtatttagaattttttgttttatagaggaaggaaataaaattaaagagatttttttagtcgttattttagttttagttacgtatttgttattatagtttaggtagttaattttagttttattttttaaatgtaggaatattttttaatttataattgtttttagtatattatttttagggaaattaaagttttggatttaaatattttagatgggaaaatttagtttttatgatgaatttagttttagaaatgatttttttttttaagtttttattggagtttttattgttataaagtatttataggaggatttttatgaggagtaattttgttagtgtatttaaaacgggattttcggttgggcgtagtggtttacgtttgtaattttagtatttggggaggttaaggtaggaggattatttgaggttaggagtttgagattagtttggttaatatggtgaaatttcgtttttattaaaaatataaaaaaaaaaaaaaaaaaaaaaaaaattagttaggtatggtggtgggcgtttgtaattttagttatttgggaggttgaggtagaagaattgtttgaatttaggaggtggaggttgtagtgagcggagattacgttattatattttagtttgggcggtagagtaagagtttattttaaagtaaataaataaataagattttgtagtttagaatttagtttttattttattttttatgtatttatttatgggatagattgtggatttagatatgtgttttattttataggatagtatgtaagttagaagtatttagtttatatggtgaagggttttttggttgtattttgttgtgtgttaatttttttagttttggttttttaatataggggtaagtatagttattttgaagttagattatttgtttttgttatgtgattttgggtaatttattttatttttttgggttttatttttttttgttgaaagagttggaaagaaggtatatgttaggtttggagtggggaggagaatattgtatgttgttagtttttagtgtgggtttttgagaagggatttttttttatttttttatttttttaatttagggatagggagggattaggattttagataggtttggaggttttgagagaggggagaatttgtttgtggataaggtttaaataattttttatgatgagaaagtatggtagtagttaagtagaaatggtagttgggtatgtttaagtagggggttttgggagtattttaggtttatgtttaatttgtgagaattttaggaagtattagtatgtgttgtgaggttttagaatagtatgaagttgttgagagggggtagataattaggaaagaatttttgtgataataaatttaataaagggagtattaaagttatagtttaagttagagattatggtacgaatgtagatatttgtgggtatagtagaaattagagacgataatttataattggtaggggtgaaatttgtttgtttttttgagtagtagaggaagatgacgatgattaaggattagataattttaatttttttattttttattttatgttatgattatataatttttatagaatgtaattatgtttttggataggagtggagggatagaatatttaattgagtattttttggaatgattgggtgattatgtatttatttgattgaatttgttaggaagtggttagattatatttttgttgttaaatggaaataagcgttgtagaaagtaattatgaaaataagagattatttgatatatttaaatattttgattttaaaattttatgtaggttgggcgttgtggtttatgtttgtaattttagtattttgggaggttaaggtaggtagattattggagtttaggagttgaagattagtttgggtaatatggcgaaatttcgtttttataaaaaatataaaaattagttaggcgtagtagtgtgcgtttgtagttttagttatttaggaggttgaggtgggaagattatttgagtttaggaggtggaggttgtagtgagtcgagatagaattattgtattttagtttgggtgttagagtgaaattttattttaaaaaaaaaaagtaaaaaatttatgtagttatagaggtagaggaattatatagatttgttgttgtttatttgttgttaatattttgcgtgatttgggataagtggtttttttttgttgagttttagtttttttgtttgtaaagtggggattataataatattaatatattataggatttttgtgaaaattagtgattttagttattagaatggttaaatttaaaagaatgataatattaagtattagtaaggatgtggaataatcggagtttttatatatttttggtgggagtataaattggtatattttagaaaattggtagtatttattaaaattaaatatatatgtatttagtggtttagtaatt

SEQ ID NO: 155 - DNA, 6180 bp, Artificial Sequence
  chemically treated genomic DNA (Homo sapiens)
gggggtatgtttttatatttgaatatagtatttatataagttatttaagtgttttaaatagtggataaaaatgatattggtaaggagtagagaattatttttatttattaatatttagagggaaaagacgaaatttttattaggaaatattataatagtgggaggtttttgttggttggtggaaaagaatgcggagagtagatggttggttattagtagaatttggtttatgagagagtaaaaagttttggtttttagtttattaatgatggtagtgttatgaattgaggataatatttattaaatttattgttatataaattatttttgttagttataaggggatagttatttttttttttttttttttgagatagttttatttttattgtttaggttggagcgtaatggtgtaattttggtttattgtagttttcgtttttcgggtttaagtaatttttttgttttagttttttaagtaattgagattataggcgtatgcgattatgtttagttattttttgtattttttgtagagatagggtttttttatattgtttaggttggtttgaaatttttgggtttaagtaattcgttagttttagttttttaaagtgttgggattatgggtataagttattgtatttggttagttatttttttatagagtagaaagttattatacggtttattagtcgttaatttcggattttagtggataacgttaggaggttagttattttattcggagagtaatttattatttttgttaaatatttgatttgatttttttttttttttttttttttttttagttttttagaatatttgttttttaaaaagggtttaaggttaagttaatttgttaaggaagtaaaaagtttattgttttagttatttttttttttgattataaaggtttttttgggtaattttggtgttttataaaatatgtatgtgtgtttaaggatgaagtgtgtgtgttgtgtgtgtggggaggttgaaattatgttgatagaatttttgtgtttgtttagtagtggattatagtgaatggatagtgaattaagttttattagattgttgggtatcgtggtttatgtttataattttagtattttgggaggtttgaggtgagaggagtatttgagtataggagtttgagattagtttgggttatatagtgatattttgtttttatgaagaaaaatttaaaaattagttaggcgtggtggtatgtatttgtagttttaggtattttagaggttgaggtgggaggattatttaattttaggaggtaaacgtgtagtgagttgagattgtgttatagtattttaatttgagtaatagagtgagattttgttttaaaaaaaaaaatttattagattataatttttttgagggtagtatgggttttagattttttgttttgaaatatttaatattatgttcggtatgtgagaaatgtatattaaatattttttaatattaatttatcgatagggattaatttatattatataaatagtattattaattaatattgaatttgtattatttagttgtttttttttgagttttttaataaaggtttttggttttatttagatgtgttagtaaaggtttagaaatgagttataagtgatataaaattttattttttatattttttttgttttttatataagttagagttattataggagatttattggtgggaattatttttttttattaaaaatgatataagtaaaggttatattatgaaaaataattttatgttataatgttaaatgaatgatagttttaattttagttttttttttttgggtttattatgtttttggtattacgttaggtgtatggtattgatagatgtatgttagttcgaatttttaaggggtttataatttaataaggaaaataaattataaagtaaaattatacgggttataatagatatgaaaaattttattaattagtttttaagtaatgagggagtttttatgattgaaggtttgggtagatagatattttttttttgtattagttgtgtgagtaggatgagaagagaattttgaaaatagtatgaatttaatatgtgggattatatattttttttttttgtaagatttttttttagttttattgtggagttatagaattttattatagtgttatggttttaatgtgttttttaaagtttatgtgttgataatttaatttttaatgtaaaagtgttgagaagtgagatttttaagagaaatttttaagagggtagagtttttatgaatggattattttttattgtgtgtgtttatttgttacgggataatacggtaagaaggttttttaaagatgttagtgttatgtttttggatttatcgggttttagaattatgagttaaataaatttttttataaattatttagtttatggtattttgttagtagtaggagaaaatgaattaaaatatatgggaatggggttttaaaaatgatttaattagattttttatttgacgtttatgtttttgttattaaaaaaatggttattggggtggtattgtgtagattatattagattatagataatagaaaattcgaattttattggtttaattagtgaagatagatttgaatttagaagttgtttgatttagagttttaaaaatgttattaaagttaggtacggtggtttacgtttgtaattttagttttttgggagtttgaggagggtagattatttgaggttaggaattttagattagtttggttaatatggtgaaattacgattttattaaaaaaataaaaaattagttgggtatggtggcgcgtatttgtaatttttgttatttgggaggttgaggtaggagaatcgtttgaatttgggaggcggaggttgtagtgagtcgagattttgttattatattttagtttggtgatagagttagattatattttaaaaaaaaaaaaaaaaaagttattaaagattagatttttatgtatgtttgtttttttgatgttttttttattttaattcggttagatttgtatttggaagatggttatttattatttaggggattcgtttttttgaggatatgtagaaagaatgggttatttttgaagcgtttttagaaaatgaaagaaaaattttttttaataaagattaggaaattgttttttttattggtttaaatatgttacgtttattgttagttaataattgtggtagggaatgggattttgttgatttaggttggaattatgttacgttgtttagattgggattatatgtttttgtaagtaggtagagtagggatgtgatttagaattgggtttgtttattaagataaggaagagtggatattggggagtttaggttattataagttttaggtatagttaatgtaaagttttggaaatttatttgatagtttcggttgtatcgttcgtttttcgtatttggggtttttaaatttcgggatttaattaattgaaaataaaaaatgtagttaggtttattaggtttgaaaatatatgaaaatatagagtttaaaatatagtttgaaaatgtattgaaaatatagagatttttttggatgattattttttaaatatattttaataattatttatatagtatttgtattgtattaggttttataagtaatttagatatgatttaaagtatatggggaaatatattatttttatgtaagagatttgaatattttagaaaatttagagtttgggaattaattttacggatatagagataattgtattaattatagtaatggtatatggtagttgaatttatttttttttttattttagttcggaatttaaaggtttttttttgttatgttgttttcgggcgttggttgtttttttttatttgttattttggaagtgttttttttttttagtgttttttttgcgtgggttttatcggtttttattgtatttatttatttaagaggtaaaataatggttgttatttaagaaaattttattttagtttagaatcgaagaattggggtttattttgttttttttttattttggggtttttttgaggttaagtttagaatttgtgtataagatagtggttgtgtgatagagttatttagggttgttttcgttagatgaagagattggtttgatttatttttaagaattagttttacgtgtagttcggttgtttcgaatgggatttgggtgcgaggggttgattggagatgtggggtttgggtgagtggggtatttgagaatttgaagtttataaggttttgtttggtttgaggtacgttttgttttttttttcgtattcggttttgtatcgaatttgatcggtcgcgtttattttcggaacggtcgaggaggatgggtttttcgtttttatacgcgcggtgtttgcgtcgattgtagtttttttggacgggagtttttgggtttagtttagggtggcgtttagcgtgatttattcgggaatggtagtttttagtgttttgcggtttcgggtttcgggaagttcggggatttgggtagcggatttagatgtttttatagttgtgttttcgtcgtttcgtttcgggggtcgagaattagtaagattaacgcgaggaggcgttacggtatttgttatttcgtttttaggaggttcggacgaggtttcgtcggcgagcggtcggggtttgtttttcgaggtgtttgcgagcgttttatgtttttttttatcggttttaatttcgtttcgttttattcgatcgcgggttttgtttattcgtcgcggtgcggttttttttagttttcgatagttttttttcgttttttttgtcggttttattttttaggcggcggagcgggtcggggagggaagggttaattcgcggtttttttcggcgcggagggattcggaggcgagtcgagcgcggtggtgaggtcgttttagcgaaaaaaatgttcgtttgaagagatttataagttttattcggggggatcgatagttcgtttcgggaggaaggggcggttaggttcgaaagtcgttttttttttttagattcgagagttcgtgcggggtaaagtgaatcgagtcgttgggcggtgtaaggggaagtttaagttcgttttttcggttaaagtgaattttaatcggggtggttggatgcggagacggggcggtaggtaattgcgggttagcgagcgggagtggggcggcgcggcggggttgggggttgcggggcgtcgtcgcgtttttgtcggagtgggggcgttttcgtttttcgttttaatttcgcgtttttttgtatagcgcgaaattcggggttttttttaagttggggagcggagtgggggcggaggttcgagtcgcgggcgtttaggttcgttggcggcgcgttcggtttgtgcgtttcgttcggtgttcgattcgggtcggcgtttaggtttcggggcgcgcgggagatcgggcggtttcggtcgcggagttaggtttattgttcggtaggttcggggtagggtagtaaaagtgggaggaggtcgagtttggggaggaggacgtcggtcgagagcgagattagttgtcggggtttttgttttttgtttaaaaacgttttttggatgagttgggggtgtttttcgattttttgggttcgtcggggacgttcgggcggcggcggtcgtagacgcgggtttgcgagcggcgcgttttttgtaatttgttagttttattgttgtcgagcgagtgagttatttcgtattttcgttcgtcgtcgtttcgttcgttggacgtcgaattgttttttatttcgtttttcgagattttagtcgcggtcgggttcggcgcgcggagtattcggcggcggcgcggagtagggggcgtcgaggaggtggtagagattggttcggaaatttgggggagaggcggcgagttgcgggagtcgtcgcgtcgatttcgggtcgcggcgaggaacgcgtggatttcgggattcggcgcgggtattgagttttttcgttttttgttcgcgtcgcggtgggagcgagtcggggttttggaagttatttcggcgtttttagcgtttttgcgtaattttttttagtatttttttttgtttttttatatattttgggtttcggtggtttttcgttgagttcgttttttttgttttagg

SEQ ID NO: 156 - DNA, 6180 bp, Artificial Sequence
  chemically treated genomic DNA (Homo sapiens)
tttagggtagaggaaacgggtttagcgagagattatcgaggtttaaagtgtgtgagggaatagagagaggtattggggaagattacgtaagagcgttgggggcgtcgggatgatttttaggatttcgattcgtttttatcgcggcgcgagtaaggggcgggagggtttagtgttcgcgtcgggtttcggaatttacgcgtttttcgtcgcggttcgagatcgacgcggcggttttcgtaattcgtcgttttttttttaagttttcgagttagtttttgttattttttcggcgttttttgtttcgcgtcgtcgtcgggtgtttcgcgcgtcgggttcggtcgcggttggggtttcgaggagcggggtgaggggtaattcggcgtttagcgagcggagcggcggcgagcggagatgcgaagtgatttattcgttcggtaataatagaattgataagttgtagggaacgcgtcgttcgtaggttcgcgtttgcggtcgtcgtcgttcggacgttttcggcgggtttaggaggtcggaaagtatttttagtttatttaaggggcgtttttaaatagaaaatagaaatttcgataattagtttcgttttcggtcggcgtttttttttttaggttcggtttttttttatttttgttgttttgtttcggatttgtcgaataatgagtttggtttcgcggtcgaagtcgttcgatttttcgcgcgtttcggagtttgggcgtcggttcgagtcgggtatcgaacggggcgtataggtcgagcgcgtcgttagcgggtttgagcgttcgcgattcgagttttcgtttttatttcgttttttaatttggaggggatttcgggtttcgcgttgtataaaggggcgcggagttgaggcgggggacgggggcgtttttatttcggtagggacgcggcggcgtttcgtagtttttagtttcgtcgcgtcgttttattttcgttcgttagttcgtaattatttgtcgtttcgttttcgtatttaattatttcgattaaagtttattttggtcgggagaacgggtttgggtttttttttgtatcgtttagcggttcggtttattttgtttcgtacgagttttcgggtttgggagggggaggcggttttcgggtttggtcgtttttttttttcggggcgggttgtcggttttttcgaatagaatttgtgggtttttttaggcggatatttttttcgttgaggcggttttattatcgcgttcggttcgttttcggattttttcgcgtcgggaagagtcgcgggttaattttttttttttcgattcgtttcgtcgtttaggaagtggggtcggtagagggggcggggaggagttgtcggggattgggaggagtcgtatcgcggcgggtggataaagttcgcggtcgggtgaggcgggacggagttggggtcggtggggaggggtatgaggcgttcgtaggtatttcgagaagtaggtttcgatcgttcgtcgacgaagtttcgttcgggttttttgggagcggggtggtaggtatcgtggcgttttttcgcgttggttttgttggttttcggttttcgaagcggagcgacggagatatagttgtggaagtatttggattcgttgtttaggttttcgagtttttcggaattcgaggtcgtaggatattgaaggttgttattttcgagtaggttacgttggacgttattttaagttgggtttagaggttttcgtttaggagggttgtagtcggcgtagatatcgcgcgtgtggagacgggagatttatttttttcggtcgtttcgagagtaggcgcggtcggttagattcgatgtagagtcgaatgcgggagaaagggtaaaacgtattttaaattagataaagttttgtgagttttaggtttttaaatattttatttatttagattttatatttttagttagtttttcgtatttaaattttattcggagtaatcgaattgtacgtgggattagtttttgggaatggattaagttagtttttttatttaacggagatagttttgggtggttttgttatatagttattgttttgtgtataagttttgaatttggttttagagaagttttagagtagaaagaagataaaataagttttagtttttcgattttgggttgaagtgagatttttttgaatggtagttattgttttgttttttaggtaagtgagtgtagtaaagatcggtaaggtttacgtagaagaaatattgaggaaagaagatatttttaaagtaataaatgggaggaagtagttaacgttcgaggataatatggtaagaaggagtttttggatttcggattgggatggaaagagaggtagatttagttattatatgttattattgtagttagtatagttgtttttatattcgtgggattggtttttagattttggattttttaagatgtttaagttttttatataaaaatggtgtgtttttttatatattttaaattatatttagattatttataaaatttaatataatgtaaatgttatgtgaatagttgttaaggtgtatttaggaaataattatttaaagaaatttttatatttttagtatatttttaggttatattttaggttttatatttttatgtatttttaggtttggtaagtttaattatattttttgtttttagttgattgaatttcggaatttggaaattttagatacggagggcggacggtataatcggagttgttaggtggatttttaaggttttgtattggttgtatttgaaatttatggtggtttagattttttagtatttatttttttttattttggtaaataagtttagttttgagttatatttttgttttgtttatttataggggtatgtggttttaatttaagtaacgtagtataattttaatttaaattagtagaattttattttttgttatagttattggttggtaatgagcgtaatatatttgggttaatgagaggagtaattttttggtttttgttgggaaaagttttttttttattttttgagagcgttttagaggtaatttattttttttgtatgtttttaaaaaaacgggttttttggatggtgggtagttattttttaaatataagtttagtcgggttaaaataaagaagatattaagaaaataaatatgtatagagatttgatttttggtgatttttttttttttttttttgagatgtagtttggttttgttattaggttggagtgtggtggtaggatttcggtttattgtaattttcgttttttaggtttaagcgatttttttgttttagttttttaaatagtagggattataggtgcgcgttattatgtttaattaattttttatttttttagtagagtcgtggttttattatgttggttaggttggtttggaatttttgattttaagtgatttgttttttttaggtttttaaagggttgggattataggcgtgagttatcgtgtttggttttggtgatatttttgaggttttgaattaagtaatttttgaatttaggtttatttttattgattagattaataggattcgaattttttgttgtttgtaatttagtgtggtttatatagtattattttaatgattatttttttagtagtaaagatataaacgttaggtaggaagtttgattagattatttttaaggttttatttttatgtgttttagtttatttttttttattgttaatagaatattatagattgagtgatttataaagaagtttatttggtttatggttttggagttcggtaagtttaagagtatggtattggtatttttagagggtttttttgtcgtgttatttcgtggtaagtgagtatatataatagagagtaatttatttatgagggttttatttttttagaagttttttttaaaggttttattttttaatatttttgtattgggggttaagttgttaatatatgaattttgggagatatattgaaattatagtattgtgataagattttatgattttatagtaaaattggaaagaaattttgtagaaggagaaggtatgtgattttatatgttggatttatgttgtttttaagattttttttttattttgtttatataattagtgtagaggaagaatatttgtttgtttaaatttttagttataggggtttttttattatttagggattgattggtgaagttttttatatttattatggttcgtatagttttattttataatttattttttttattagattgtgaattttttgagggttcggattgatatgtatttgttagtattatgtatttaacgtagtgttaagagtatagtagatttaaaaaggaggagttggaattaaagttattatttatttgatattataatatgaagttattttttataatatagtttttgtttgtgttatttttaataagagaaaatgatttttattagtgaattttttataatagttttgatttatatagaagataaaaagaatataaaaagtggagttttgtattatttataatttatttttgggtttttgttgatatatttagatagggttagaagtttttattgaaaagtttagagagaaataattaagtaatataaatttagtgttaattaatagtattatttgtgtagtataagttaatttttatcgataagttaatattgaaaagtatttaatgtgtattttttatatgtcgggtatggtgttaaatgttttaggatagaaggtttaaaatttatattgtttttaagaaagttataatttaatagatttttttttttgagatagagttttattttattgtttagattaaagtgttgtggtataattttagtttattgtacgtttgttttttgggattaggtgatttttttattttagtttttgaaatatttgagattataggtgtatgttattacgtttggttaatttttaaatttttttttatagagataaggtattattatatagtttaggttggttttaaatttttgtgtttaagtgttttttttattttaagttttttaaagtgttgggattataggtatgagttacgatgtttagtaatttaatagagtttagtttattgtttatttattgtaatttattattggatagatataggaattttgttaatatggttttagtttttttatatatataatatatatattttatttttgaatatatatgtatattttatgggatattagagttgtttagagaaatttttatagttaaaaggaaaagtagttaaagtaatgggttttttgtttttttggtagattgatttaattttggattttttttagaagataagtattttaggaagttaagaggagaaggagagagagaagagaattaagttaggtgtttagtaggggtagtaaattatttttcggatgaagtgattggttttttaacgttatttattaagattcgaggttgacggttagtagatcgtatggtagttttttgttttataggagaataattggttaggtgtagtggtttatgtttataattttagtattttgggaggttgaggttggcggattgtttgagtttaggagttttagattagtttgggtaatatggagaaattttgtttttataaaaaatataaaaaatagttgggtatggtcgtatgcgtttgtagttttagttatttgggaggttgaggtaggaggattgtttgagttcgggaggcggaggttgtagtgagttaagattgtattattgcgttttagtttgggtaatgggaatgaaattgttttagaaaagagaaaaggagaataattgtttttttgtgattaatagggataatttatgtaatagtgagtttaataagtattatttttagtttatggtattattattattgatgaattaaaagttaagattttttatttttttatgagttaaattttattaatgattaattatttatttttcgtatttttttttattagttagtaagaattttttattgttgtggtattttttggtagagatttcgttttttttttttgaatgttgatagataaaaatagttttttattttttgttaatattatttttatttattatttaagatatttagatggtttatatgaatgttatatttagatatgaggatatgttttt

SEQ ID NO: 157 - DNA, 5285 bp, Artificial Sequence
  chemically treated genomic DNA (Homo sapiens)
gtcgagagttagtagtttagtttttcggcggttttgggtaagttttaataggatgttaggcgggttggtgagtaggaagagacgtcgtttataatttttttttgttgtaatttattaaatttatttggggtttttttgagacgttttttggaaatgttatattttaagggtttttttgttagaaaaggttagagtttacgtgggttttttatgttaaaggagtttgaaagaaaaggaaaggaaatgtatatttttagttttagttatgattaagtgggtttaggttatgagaatatttagatgatttatatgacgttatatgaagagttaattagtttaataattttcgaaaaatatttcgtttaagagtatttattagatatttggaatgtattaggttgttgttttaagttttttattagggtatagtggtttatttcgattgtattttaatagagtagggtaggtttgcgtatgatatttatttaatttatggggagattgaggtttagagagggttagtaatttgtttggggttttatagttagtaagtggtacggtagagatggaaatttaagattgtttaaatttaaagttggagtttatttgttttaataatttttaagttttgggagttttgatttagttttgtttttagtatttgattagtgtaagtttatttgcgtgaagatgaagttttattaaattattagttttggtttggtttggatgaatttagaagattttggggtttttttgtagttggttttggttttgaaatttttcggttatttttaggggggtaattatagtagattgtatttattattttgtggaagaattttagtgtttattatttgtgtatgtgatttgagttaatttttagaataggtggtttcgggtgggtttagtagagagatggtatatattgagatttgtttggtttaagggagagattttaggttttttttgttagtaaaggttttgggttttttatatagattattaagatgattttttaattttgttgatggttttttttatgtaatatgagttatttagaaagttagggttttatattagtgatagtttatttgttagtatttgtttgttaagattataaggtagataaggattttttttggaattttataatggaatattagagtgtgatagttaggatgtgggtttaggagttagattgtttgggttttaaattttgatatttttatttttaagttgtgagaatttaggtgattttatttttttgagttttagtttttttattagttaaatggggatacgagtttttatgttatagggttggtgtgatgattaaatgagataatgtgtgtgaagtttttgataggatgtttggtatatagtaattatttagtatatgaggttggtcgttgtgtagacgatggtgaaggaattagtgttgattagattagggatttttgtggggtcgtattaatttttggggaataaattagagtttttgtttttttttagttttttaaatttttttaagttatttaggtttatatgaaatttattttttttaggaagttattttgattattttagtttatattgattttattatatttgagttttttttgtttattatttgtatagattattttagtatttaaatcggttttaataattttttagttttttaaagtagttaatggtttttggaagttagatatttttagtttttttttttttatagtttaagttagggttaggtatatagtagatgattttttagtaagtttttagattgattttagtgtggttgtggatgtttgtgatttagttttttttttttttacgtttttttatagttttattttttttatttatttatttttttttttggttttagttagtagggtggggagttggagttatgattttataggatagttgtttttagattataaaatgtttaaagaaatttgagggtgggggagttaatagatggggaaaaaaatgttttttatgtttttttattaaataaagatatgaaaaaaaatatttgttttattattattttagtaaagaaaggatgtttttatattaataaagtagtaagggtataatttttgattaaaggttaatacgaagttggaaagttttaattttattgagaaaataaaataaaataaaaagaattttattgttgttgtgattttttttttttttttaaggattggagaatattttagtttttattgatttgtgtcggtggaatttatgggtttggggatagttattttggaggacgtttttgttgaattagggttttttataaatatatgaggatttttaaagttattgggttgggtagattcggatttttttttagttgttttagaggaggtttattttatgttagattttatttataattttaggagttgaggtggcggaggttttgaattttcgtttttgtatttttttttttcgggtagggtcgagttttttttttttcgttaattcggagtagatgaggcgagattgagcggtaagtttattttgggaagaggttggggagatttaatgggtagggttttttttatttttattattaagttgagtattcgtgtttatgttattttttagttttagtttggggaaaggaggaaaagtgggtattttagttcggaggtggcgggggaggggggtgtgggggttggtgttcgagatattcggttgggcgggtatagataggatttgaatatagggaagtatggtttagttttttgatttatagttagttacgttgggtttggattcggagggaggtacggttgtttttcggttcggttttgtatcgttgttaggggttttgtggggtttttagagggagaggcgtttaatattcggtttttttttaaatattttttattttaattgtttttagaagaggcgtgagcgtttatagtgaatttagtatagaaatttgttaggggagttgttgttgattgtatcgcgatttaaaggatcggcgttttttgtagatgtaggggttgagttaggttaagcgcgtcgtggaggttcgcgtggacgtagattcgggtgttatatagatgcgttggaatttaggtattttttcgcgtttcgtaaatttagatgttttagtttggatcgagcgagggttagagggttagttaggttagggttaattttagagttatgggttttttaaatgcgatttttagggttgagttgttgtggacgagcgatttatgtcggaatttcgcgtttacgtggttgtttaaagtttcgagttttcgggttgtaggttttagttacggaatcgagttgggagagttataggggttgggatttggaggatcggttgaggttcggtgtttttggttgtgttcgcggttcggagtcgtcgtttgattgaggggttcgttatagatgtgtgatgtataagttttgtacgtaataggagtttaataaatgtgcgaaggggggtatatttatgatcgtattgtatgtaggcggtttagaaggaagtttttgattggtatagggatggaggatggggtaagagtcgtaatagcgtcgcggagttttaacgttgtcggttttttggggtacgagtatagttttaagtagttttaagttttaggaagtttttagtttaaagtatagggcgtattggagtttgggtacgatatagtttatattacggttgcgatggtaagttacgtttaagttttaagggtttaggggattttcgttttttatagtcggaggagaaatttgggcgtagaaagtagggggaatatttggttgtaggtgagtaagcggggttaggagttttcgttagagtttttgcgtttcgggagaagggtgattatttttaggtttgttcgacgttttttttagggtgcgtttcggaagagcgagttttttaaggttatgtcgagtgggcgcgtttcggtttttttcgggagaggagaggcggggcggatttgtgtttcgttttcggttcggttcgtttttagtgttcgtttcgttttcggtattcggtcggcggcgtttttgatgtttcgattcgttagttcgcggagtcgttttgtttcgcgttttagttcgcgtttgtagttcgtttaggcggagttagttcgcgtttcgttcgtcgcgattcgggttcggaggttcggatttcgggttcgtcgtttttcgggtcggtttcgcgtttcgtattttcggcgtttagcgtttcgcgtttcggcgggcggagcgtattatgtcgtagttggatttcggcgggggcggcgcgggcggcggcgacgatttcggcgcgtcggacgagttgttggttttttaggatgaaggcgaggagtaggacgataagagtcgcgatagcgtcgtcggtttcgagcgcgatttggtcgagtttaagtcgtcgttcgtgaacgagttcgagggcgcggtcggcggcgtagggatttcgggggtttcgggggtcggcgtcggggttcgcggcgaggtcgaggtgagttttcgtcggcgtcggtttttttttcgcggtcgtcgcgtcgcgtcgttttagttgcgcgcggttttcggggtttttagcgcgtagagcgtttttgtttcggcgtcggtttcgattttcgcggttttatcgttttttattttttttcggttttttttttaggttttcgggcgggaatacgttgcgtagagatttttttcggataaatttttagagtttttggaggacggtgagtttttgttcggttcggttttttttcgtcgcgtttaggttttggtttcggtgggacggggacgttaaggatcgcggggagtcgggtgttttttttatcgtagtttaggaggcggtagaatttaggggtggagagtggggggcgggtttttcgggcgtcgtcgggtcgagttattttcggtgttttgatttttataggagtaaatagattttcgttattttcgtttttttttttgtttaggtgattgattaattcgtcgtttttaggagatagaattggttaaggttttttggttggagggcggggggtgggaggttaagtaggggttatttcggggaggtttgttttttaggttttttttttaaaatttggtattgtcgatatttttagttcgtttttttttaagttaggaatttgtaggggattttttggtaatttttttttttttaagagtagatagtttttagttttagtcgttgttagggttggtgtgtttgatttagttgtggtttttttagg

SEQ ID NO: 158 - DNA, 5285 bp, Artificial Sequence
  chemically treated genomic DNA (Homo sapiens)
tttggaaaaattatagttgggttagatatattagttttggtagcggttgggattgaaggttgtttgtttttgagagaaaaagaattgttaaggggttttttgtaagtttttgatttgggaaggaacgggttgggagtatcggtagtgttaagttttaggggaaggatttggagggtaggttttttcgaggtggtttttatttgattttttatttttcgttttttaattaagaaattttggttaattttgttttttgaaggcggcggattagttagttatttgggtaggaggggaggcggggatggcgggggtttgtttatttttataaaggttagggtatcggaagtgattcgattcggcggcgttcgggaagttcgttttttattttttatttttgggttttgtcgttttttgagttgcggtgggggaggtattcggtttttcgcggtttttggcgttttcgttttatcgaggttagggtttgagcgcgacgaagggaagtcgggtcgggtagaaatttatcgttttttaggggttttggaagtttgttcgggaagagtttttgcgtagcgtgttttcgttcgagagtttggagggagaatcggaggggagtgaggggcggtgggatcgcgggggtcggggtcgacgtcggggtagggacgttttgcgcgttggagatttcgagggtcgcgcgtaattggggcggcgcggcgcggcgatcgcgggggaggagtcggcgtcggcgggggtttatttcggtttcgtcgcgggtttcggcgtcggttttcgggattttcgggatttttgcgtcgtcggtcgcgttttcggattcgtttacgagcgacgatttgagttcggttaggtcgcgttcgggatcggcggcgttgtcgcggtttttgtcgttttgtttttcgtttttattttggaaggttagtagttcgttcggcgcgtcgaggtcgtcgtcgtcgttcgcgtcgttttcgtcggagtttagttgcggtatggtgcgtttcgttcgtcggggcgcggggcgttgggcgtcgggagtgcggggcgcggagtcggttcggggggcggcgagttcggagttcgaattttcgagttcggatcgcggcgggcggagcgcgggttgatttcgtttgggcgggttgtaggcgcgggttagggcgcggggtagagcggtttcgcgagttggcgggtcggaatattaaaggcgtcgtcggtcgagtgtcgggggcggggcgggtattgggggcgggtcgggtcgggggcgggatataggttcgtttcgttttttttttttcgggagaggtcgggacgcgtttattcggtatagttttaaagggttcgttttttcggagcgtattttgagagagacgtcggataagtttgggaatgattatttttttttcgaaacgtagagattttaacgggaatttttgatttcgtttatttatttataattagatattttttttgttttttgcgtttaggtttttttttcggttgtggagggcgggggttttttaggtttttgggatttgggcgtggtttattatcgtagtcgtggtgtgaattgtatcgtgtttaggttttaatgcgttttgtgttttgaattgggggttttttagggtttgaggttgtttgaggttgtgttcgtattttagggaatcggtagcgttggaatttcgcggcgttgttgcggtttttgttttattttttatttttgtgttaattagggatttttttttaggtcgtttgtatatagtgcgattataagtatattttttttcgtatatttattgagtttttgttgcgtgtagagtttatatattatatatttgtgacgggttttttagttaggcgacggtttcgagtcgcgaatatagttaagagtatcggattttagtcgattttttaagttttagtttttatgatttttttaattcggtttcgtgattagaatttgtagttcggagattcggaattttgggtagttacgtgggcgcgggatttcgatatgggtcgttcgtttatagtaatttaattttagaagtcgtatttagggagtttatgattttgaagttgattttggtttgattaattttttaattttcgttcgatttaggttgaaatatttagatttgcggagcgcgggaaagtgtttggattttagcgtatttgtatggtattcgggtttgcgtttacgcgggtttttacggcgcgtttggtttggtttagtttttgtatttataaaagacgtcggttttttggatcgcgatgtagttaatagtagtttttttagtaggtttttgtgttgggtttattgtagacgtttacgttttttttgagagtagttgggatagagggtatttgggggagggtcgggtattggacgtttttttttttgagggttttataggatttttggtagcggtgtaaagtcgggtcggaagatagtcgtgttttttttcgggtttaggtttagcgtggttggttgtggattaaagagttaggttatgtttttttgtgtttagattttatttgtgttcgtttagtcgggtgtttcggatattagtttttatatttttttttttcgttattttcgggttagggtgtttatttttttttttttttttaggttggggttggggggtggtatgggtacgagtgtttagtttggtgatggagatgagggggattttgtttattaggtttttttagtttttttttagggtgggtttgtcgtttagtttcgttttatttgtttcggattggcggggaagggggggttcggttttgttcggaggggagaggtatagggacgggagtttagagttttcgttattttaatttttgaggttataggtagggtttggtatagggtgagttttttttgggatagttgaaagggaattcggatttgtttaatttaatggttttaggggtttttatgtgtttgtagggaattttggtttagtaggaacgttttttagaatagttgtttttagatttatgagttttatcgatatagattagtggaggttgaagtgttttttagtttttggagaaaggagaaaagttataataatagtgaggttttttttgttttgttttgtttttttaataaggttaaaattttttagtttcgtattagtttttaattaaggattatgtttttattgttttattggtgtgaaaatattttttttttattaaaatggtggtgggataagtgtttttttttatgtttttatttggtgaaagaatataaggaatatttttttttttatttgttaatttttttatttttaagtttttttggatattttatagtttgggaataattgttttatggggttatagttttaattttttattttgttggttggaattagaggagagggtgggtgagtagggagagtgggattgtgaggaggcgtgagggagagaagggttgagttataggtatttatagttatattgaaattagtttgaaggtttgttaagggattatttattgtgtatttagttttggtttgggttgtggagagggaagggttagaggtgtttgatttttaggagttattggttgttttgagaagttgaagagttattagagtcgatttaggtgttagagtagtttatataggtaatggatagaaagagtttagatatggtgagattaatgtggattagagtagttagggtggttttttgaaggaggtagattttatgtgggtttggatggtttaggagggtttggaaagttggaaaggaataagagttttgatttgttttttagaagttggtgcggttttataggagtttttggtttagttagtattgatttttttattatcgtttatataacgattaattttatatattgagtgattattatgtgttaggtattttgttaagagttttatatatattattttatttaattattatattaattttgtgatatagggattcgtatttttatttgattaatgaggaaattgaagtttagagagatgaagttatttaagtttttatagtttgaaaatgaaggtgttagaatttgaaatttaggtagtttgatttttgagtttatattttaattattatattttagtgttttattataaaattttagagggagtttttatttgttttgtggttttggtagataaatgttgataaataagttgttattaatatggagttttgattttttgggtggtttatgttgtatgaagggggttattaataggattagggaattattttggtggtttgtatagggggtttaagatttttgttggtagagagggtttagaattttttttttgaattagatagattttagtgtgtattatttttttgttgagtttattcgaggttatttgttttgggaattggtttagattatatatatagatgatagatattggggtttttttatagggtagtgagtgtaatttgttgtggttgtttttttggaggtgatcggggagttttaggattaggattagttgtaaggaggttttaaagttttttggatttatttagattaggttagggttggtgatttaataaggttttatttttacgtaaatgagtttgtattagttagatgttggaaataggattaagttaggatttttaaggtttgagggttgttggagtagatgagttttagttttagatttgggtagttttaagtttttatttttgtcgtgttatttattagttgtgggattttaggtagattgttgattttttttgagttttagtttttttataggttaaatggatgttatacgtaggtttgttttgttttgttggagtgtagtcgagatgaattattgtattttagtgaagagtttagaatagtagtttggtgtattttaagtgtttaatgggtgtttttgaacgagatatttttcggaagttgttaggttaattggttttttatgtaacgttatgtaaattatttgaatgtttttatggtttgagtttatttaattatggttaaagttgaaaatatatatttttttttttttttttttaagtttttttaatatgaaaggtttacgtgaattttgattttttttgatagggagatttttgaaatgtggtatttttagaaaacgttttaaaggagttttagatggatttagtaaattatagtaaggagaggttgtgagcggcgtttttttttgtttattagttcgtttggtattttgttggggtttgtttaaagtcgtcgggaggttgggttgttggttttcggt

SEQ ID NO: 159 - DNA, 9515 bp, Artificial Sequence
  chemically treated genomic DNA (Homo sapiens)
agtatttttattttttaagattttttttttttaaagtaataatatggaaaatatttataatgatgaaagtatttgtttttttgtattagttatggtagaggagatatatattttttatattttgaatgtgaaatgtttattggtgttgaaaataattgttgtatggttgtttgtattatttgttttagttttttatttttttttttttaatttttttatttttaagagataggaattttaaaattgtttttttagttattttatattttcgtagttaaatagaaaagtttaaggggattaggatatttaaaatttataatgaaattattattgttttttaaaagttttagggaaagggtgagtttttatagttatagttatttttatttttataagtgattttaatttagtattttttataaatttataaatgtattattaattaaatattatgattaaagtaagaaatgtttttttttgtttagtgtttgttttaatttcgataattatgaagagttagtttaaagataattttatttatattttattttttaaaaatatttttgtgtaaatattagttttttttattttgtttttttatattaagttattgaaatttatatggtattaaagttttagaaatttgaaggtaggtgtttaaattgtagttttagatatttaatagtattttgtttttaaattgatgataaaaatatttattgaattttttttaaaaatataattatgagaaagtttaagatagaaatatggtaggaaaattaggagttagattgtaatagtaaaaaatggagttgttatgttttattattttttaatttattaagatttgttatatggatgtcgtgttttattatttaatttagtagataataatgtttttgatgggtaagaggtggggtaatatttgaggatgttgaagtaagatagttttttttttttttttttttttttttgtttatttataaatttaggattataaaaaataattttggatatatttaatgatttaaaaatattgtttttttaattttagaaggaaagaagtaagatagtattatgagattgtgggtaaagcgttgagtatatagtttgaagatttatattgggttttttatttttattttttaattaggagtttattgtaaatttttggtttttagaagtttttatttttttgatttttcgttaagtgttttgagataatgatgataagttaaattgtttatgaagtaatagtattatatatatttatttatagatattattttaataaatttttataattatttttattttgtagtttagtgtattgaattttaggttattaaatagtttgttttatcgtttagaatgagaaaggttagggtgtaaatttggtataataattttaatttttgatttttttaattttattatttttgtgcgttgggtagatggaaaggggaaatttagggagattgtgtaatggaaaaagaaaaggtggtatagtgggtatttgtaaaggaagatagtttatggagtgttaatttataggtgtaaaggtgagggttagtggaaggaaggaagttaaataaatttagataatttataattagatttttagaagaaagatgaaagaagatatgaaagtgtttttagttgattttgatttaataatgatatttttttgtatattttttaaaaaatagttttgaatatatttcgaaaattattagtagagggttttatgttgggtgtatttgtttttaattatagatttcgatatttattgaataatattttttttatatgaggttgaaaaaaaaagagggtatgaataatttttttttttgttgttttaaattgaaataaatgtaaatgaaagaggaaagtacgagtgttaattatttgggatgttttaagtgcggttttatttaggagagtatgtgcgtaatttgaaaaagaaatatggatataaggtaagataaaataacgaggaaaatgtatattttattcgtttaattttttttaaatttagagtttgttttgtttttgtgtttttatttattgagtttttgcgggaatagtttttttacgttatgtgattgagtgataacgcgaaaggtaatagaaagtaaaagtaagagaggtaggtttaagttaggaaaaatttttttcgtagcggttgagtttttattgtgcgttttttcgggcgtttgaattttttagatgttggaacgatcgtttttaaaattagtaaatattataagaagtgaattttaaaaatgttttttttaatattaggtttttaagaacggaaagaaatttttgtcgaaaaagaaattaaggagatttgtagggtttgcgtttataaaatttcgatagagggcgttgttgttcgtttaatgatagggaacggttcgtgggaacggtttattttgtaatgtttaggatttttcgaataacgtttacgttaaaaaaaataattaggattttaattatggttatgtattttgaaggtatttttttatatatatgtgtatatttttaggtttatgttttatttttaataaaattagatttgttattttttaggttttttaaagaatttaaattttaattaaatattttaagatatttttattttaaaaaatatttaatattagtataaaataaaattatatataaaaagtttgaaattatttatatataaggttataaaatagttatattaatataatattttatattattttaatttatgtgtaaaattattttttgtaggttttgttttgttaaattttagagtttatttattttagattaggtaataatatattaaaaagatattaaaaggtgttaaaagtatttagagaaaaaaagtgagatttttttaaatgtattttatttgggttgtaatgatttttaggtaataataatgatagaattattgatttgaaagggagaaaataattatttttattaattaaatgttttgtgtttggagaatttgaatttttaagtttataatatttattttttagattattgatttggtattgattttagttttagaagttagggggtgtggaattcgttttaagttttattatataataagattaagaaaaatttttttttattttttaattagttttggaagtaaagaagaaaatttttgttgatgtttttagtgaaaaatttgtatagattgtgtatgatttaaggttaatatttaaaggggaagaaaggaatggagagagaaaggaaggaacgaaaagggaaatgaaggaaagaaaaaaggaaaataaaaaggaggaagaggagaaaaggaaagacgaaatataaaaaatttaatcggaaataaggggtttatttttgaagttttttttgaagtattttttttgtgttttttttttttgatttatttttaaaaattaaattaaaaatttgtagaattgtttattttgtagtttatgaagtttttttttggttttgattgaatcgacgtttaataaggttgttcggagttttgtatttaaatagcgtttatttttgttcgcgtagagttgtatatagtagttttggatttaaagataattattttttgtagatttatttttattaggtttaataatttttattttaaattgttttattttttttcggttttttttggtattttttttttgttttaggcgtagagatttttttttgggcgtttgtttcggttatgagaagtttttcgtattttgaaagggagtagaaaaatagaggggatgggaaagggggaataggggaatagatgagtatttattttatgataaaatttagaatttttgcgttttaaatggtgtttattttttaagtttggttaatattgtttttgttgttgatgatgtttttttttttaaaaattatatgaattattttattaagaaaaattatataaaaaaaagaagaaattttatatgtattaaaatattttttattatttttttgaagatattttgtttaaatttttttaaagattcgggtggtttttttttgattttttatgattaaaattatttataagttatatataatagatgtaaatataaaatgtttttggtttttgtaaaaaaggtttaaaattaattttgtttgaacgtgtgcgtacgttgtttttaatatttgaaaaaaatttgataaaatggagattttagttaagaggaatggtgtatggaattcgttgaaaatgtatataaataatatttaaaataataagtagtataaattgaggtgtatttaagtttttaaaggttttaggtaaaatgattagaaaatattagaaatggttattaacggtggttagtttttttgttttatggtgatagagataaagttaaaaaaaaaaaagttgtgtagttattaatatagagatagtttttaaaattttttatatttagttttttaaaatattttttttcggaatatatatgaataggagggagtttttgtgtttaaaaattttggtaagtgtttttttttaaaatttatatagaaaataggggattgatggtttttggttttttattatgaattgtaaagattttagttagtggttataatgatgtgttattttcgatatagaagttataaaatgtatatattatattaattattttgaataattttttgttaaatgtatatttggagtttgtagattgtgtgatttagaggtgtttatataattatatgtgggtgtttgggtgtaaatacgggtttatgatttttatagtatatatgtttgtgggttgtatttaatttttgtgtgtgtaataatgttttttttttttgttgaggtttatttgtttagtttattgtttgagataatagatataagttgcgatgggagaggagcgtcggatttggtgtgtattttttatttttaattatagatggattattatagatagcggagttttgagaagttagatatttgttttttatatgaatgtatttattttttagagattaggttgttattatgttttggaagtttgtggagaatgttaagtacgaagatatttatgaggtgagtcgatatttttagatgtattttagagttttgtagatagagaatttgagttttttgatattttaaatgatatatatttttaagttatttattcgtagattttcggtcggtttttttagttttttttaatttttagaaaagttggttagggaagatttcgttgttttgaaaagggattttaaggttgaaatttgataattttaatttaggaatgtttttatttattttatttttttttttttttttttcgtttttttttattttattttatttttttaagttttgatggggaatgtggtgttattgaatgtgggtacgtttttagagaaaatcgagattttgataaagttaggggtttttttcgttttaagtgtggaagagaattgggtttttaagttttatttgtaatagattcgggtttttaatttttatttttaataaaatttttgaaattgataataaatggttttaagtagaggatagagaattagcgggaaagaagtagatggttggagatatggatggatagagtaaaatagaagtcgtagtagtttattagtttttgtttttttgtgttttgtttttttgagggttattgcgttcgaatagaaatcgtagtcgttttttgtgtgggtattttttacggaaatttttgtttacgtttaatgcgtacgggtttttagtattgaggttagtttaatttttcggggtaggagaagttgcgtttagttaggaggacgttagtcgttttcggggttcggatcgcgttcgttaaagttttttttcggttcgggcgagggttgacgcggttagacggtttcgttattcgcgggcgaggcggattaggcggacgaggcggtcgaggcgggcgaggtgggagaggcgggcgaggtgggagaggcggtcgaggcgggcgaggcgcggggcgcgcggcgggttaggttggggatcgggaagttcgcggagtttcgtttttaagcggaatggtttgggatagttttaggtggttgttaggggaagggaggaagggaaggttttgttgagacgtcgaggttggaaataaaaatttcggaaaggcgaagcggatttagaaaaggagggaagtcgaggcgggcgaagcgggttatggagattgttaagaggaaaagttggagagaaaaggaaggaagagaagtagattttcgggtggcgggcgcgggtcgttaggttagacgaaaggtggagggatgtagaggttttttaaagagtcgagaaagatacgcgattttttcggatcgggatagtttttgaaagttcggcgtagagtcgtttcgaagattttaagagtgggcgatttataggcgcggtcggtaagtttttgggggattcgggttcggacgagcgtttataggtagcgtttggcgtttatattttttgttttttttcgaattttaatgttggggtgtgtgtatgtgtggaggtatgtaggagagaggaggaggagataagagaggagagggagaaaagtaggagagagcgcgagagagtagagaggagagagattggttttgttgttgaatgatgtttggggttttttttttttttttgtggttgtgtatcgattgtaacgaagagtcgcgtttacgcgtttggtggggattgtttcggttcggtttttttttttttttttaataggcgggataatggtaaagtttaaggcgttagaattgttttaaagaatattagcgtttaaagtgggtatgatattagtaagtacggggttatggtgaaaatagtttaagttatatgtatgtagaggtattttagtgggttttaaaaagtaattagggtaatattcgttttttatagaaagtaaagtagttaaatggaaaaggaaggagggagagaagaaaggagggagggagagaggaagagggaggggtggagtggaagggagggaagagagaagagaaaagaggggagggagagagagaaagagaaataaatagggagagagagggaatattataggtggttttatttgtttaaattttttgtttaaaaaatagaattcgtagttcggtggaaggagtttatttaagtttggattaaggttgaattttaatagaaatggtagttaggttagttgaacgggtttttgaaatatttaaaaaggttttttgttgtttttggttttgtttggaaaggataagtttagtgtatttgaagattgatggcgtatgttttaaattgaggtaaaaatcgtaaattatgtgagtattaaataggaaaaggttgtataggaatgaaaagtttttatttcgtttttgttttttaataaatgagtataattttttatatttagtaaaagtttgtaaaagttattgtaaataattaggtttattaatttgtttttttttcgtttttaaatgatgaagtaattttttttattttgtttttgtaatttttatataaagtatttaaggcgattaagtttttcggattagggaagtttttttttaggtaggaggatatttttattttatataattttttagtattgtttttttttattgttttatttaaaggagtaggggttgttttattcgtgttttcggtatagttaattgaagttttgttttttttttgttaaattttttttttagtttgtttttgttagttttttcgtttgattatatttagtaattttttattgaatgaacgttatttataatagtaggggagttttgcgttcgttgttgttttacgttttatttgttttttattttttttttaaagtattcgtgtaatattaatagttatgaatattaattattatgaggcggtgtaggtaagcggagggaggaaggggcggtcgagtagtttgagtttagtttcgggtgaaagaggattgtatttggagtttcgaagaacggtagaagaaaagaggttaaaaagatagtaaagagatagatgaatagttttgtttgtgtgtgataggtatcgttaattttgttggggtggggggcgggtgtaattttttttttttttttttgatggtttgttttggaaatatattaagtttagtttttgtgtttagttcgtttttttgttggattttttgattttttttttaattattgtttgattttgagtagtaattaggtttttttttttagatgttagtttatatttatttatttatggtgagtttggatttacgtgttattagaattgtatgttttttttttttattgtttttttgtttttgcgtttttgtgtgtgtgtgtgttttatattttttgtttttttttgtttttttttgagcgtttttggtttggtaatttagtattataattggacgaggttgtagttgtttttttttgtattgtgtgtttttcgtttgagttttatgagttagttgggaggggagaggtcgaaaagaaaaattttttatttgttattgttgtttggaaatttaggtgattatttttgtaaaaagaattatggggagtttattatgatgtttttagagaagagagggagaaataaagtttattttttttatatatatattttttttttttttttttatttagtttatattttagataggattaggaataagttgtttgggtttttatttttttttattttaattttagtttttttatttttatattttgagtataatagtattagatatagaaaaatagttttagaaataatttttatgaattataatttaatttaatttattattggtttaggatatgatttcgaatgagatttattttaatgaaatattatttaagttatttaattttttttggagagggaggagtgattgggaatttagattaggtggattttttggagtttttggaatgattaggttgtgtggaaagttttttttaattagttagttgtatttttagcgaaggtagaagttggtttttaattagggggagtagtatagtaaatattatgaagttttatttgttgtgatttgtatttttggaagagttagaaaaaagtagttaaaaatatttagaggagtaaatattatatgtaagatttttataattttaattaaggtatttagaatttttttttatatatattgtttttgtatttttgttttttgtttgttttgtattttttaaaaagcggttaaaatgttatagttaagtgggtgattttttttttattttttttttaagtttggggtttgaaattgttgaaattatgtggttttttgagttaatttgggggtttaagttttagatttttgttttttttgtttcgggaagagcgtataaaagtcgggtttttttatttgttatttgtattttttttttttttttttgtattttttgtttttttttgtttttatttttttttttttgtttttttttttggtttttttttttttttttttttcgtttttagg

SEQ ID NO: 160 - DNA, 9515 bp, Artificial Sequence
  chemically treated genomic DNA (Homo sapiens)
tttgggagcggagagaggaaggggaagagagttagagaaggagatagagaaagagagatagaggtagagagagatagagagtatagagaggaagaaaaaaaatataagtgataaatggagaagttcggtttttgtacgtttttttcgggataagggaagtaaggatttgaaatttagatttttaagttgatttagagggttatatgattttagtaattttaaattttaggtttggggagaaaatgggaaaggaattatttatttaattataatattttagtcgttttttggggagtgtaaagtaggtaaaaggtaggggtataggaatagtgtgtatggagggagattttaaatgttttaattaaaattgtaggagttttatatatggtgtttgtttttttgggtgtttttaattatttttttttaatttttttagaggtataaattataataaataaaattttatagtatttgttgtgttgttttttttgattaaaaattaatttttgttttcgttggaaatgtagttggttgattaggaggagttttttatataatttgattattttaagagttttaaggaatttatttggtttgagtttttagttatttttttttttttaggagaaattaaataatttaaatagtgttttattgaaatggattttattcgaaattatattttaagttaatgatgaattaagttgagttgtggtttataggagttatttttaagattgtttttttatatttaatgttgttatatttaggatgtgaaaatgaaggaattaaagttggggtggggggaaataaaagtttagataatttatttttggttttatttggagtgtgaattaagtgaaagaagaagggggaggtgtgtatatgagggaggtggattttgttttttttttttttttttggaaatattatggtaaattttttatggttttttttgtagaaatagttatttaaatttttaaatagtaatggtaaataaaaagttttttttttcggtttttttttttttagttgatttatggagtttagacggagaatatataatgtagagagaagtagttgtagtttcgtttaattatggtgttaaattattaagttaaaggcgtttaaaggaagatagagagagatagagagtgtgagatatatatatatatagagacgtagagatagagagatagtgagaggagggagtatgtaattttggtaatacgtgaatttaaatttattatggatgaataggtgtggattaatatttggaaaaaaaagtttggttattgtttaaaattaaataatgattaaaaaaaaaattaaggagtttagtagagaagcgagttggatataggagttgagtttgatgtgtttttaggataagttattaaaaaaaaaaaaaaaaaattatattcgttttttattttaataagattggcgatgtttgttatatatagatagaattatttatttgtttttttgttgtttttttggtttttttttttttgtcgtttttcggggttttagatgtagtttttttttattcgaagttgggtttagattgttcggtcgttttttttttttttcgtttgtttatatcgttttataataattgatatttatgattattaatattatacgagtattttaaagggagaatagaggataaatggagcgtgaagtagtagcgagcgtagagtttttttattattgtaaatgacgtttatttagtggagaattattagatgtaattagacgagggggttggtaaaggtagattggggaaaaagtttagtaggaaagaggtagaattttaattaattgtgtcggggatacgagtaaagtagtttttgtttttttggataaggtagtgagggagaatagtgttgggaggttgtatagaatggaggtgtttttttatttggagagagatttttttaattcggaggatttggtcgttttgggtgttttgtgtgaggattataaaaataaaataaaaagggttgttttattatttggaggcgagagaaaggtaaattggtgggtttggttatttatagtgatttttgtagatttttgttaaatgtggaagattatgtttatttgttaaaggatagaagcgagatggaggttttttatttttgtgtagtttttttttgtttagtgtttatatagtttgcgatttttattttaatttaaaatatacgttattaatttttaaatatattaaatttattttttttaggtaaagttaggggtaatagaaaatttttttggatgttttaggaattcgtttaattggtttgattgttatttttgttaaagtttaattttagtttagatttaaataggttttttttatcgagttgcggattttgttttttgagtagaaaatttaggtagataggattatttgtaatattttttttttttttttgtttattttttttttttttttttttttttttttttttttttttttttttttttttttttattttatttttttttttttttttttttttttttttttttttttttttttttttttttttttatttagttattttattttttgtaaagaacgaatgttattttggttattttttagaatttattgaaatgtttttgtatgtatatagtttgagttgtttttattatggtttcgtgtttgttaatgttatgtttattttgggcgttaatattttttaggatagttttagcgttttggattttattattatttcgtttgttaaggaaagaaaaggaggtcgaatcgaaataatttttattaggcgcgtaggcgcggtttttcgttatagtcgatatataattataaagagaaaaggaaaattttaagtattatttagtaataagattaattttttttttttttgttttttcgcgtttttttttgtttttttttttttttttttttatttttttttttttttttttatatatttttatatatatatatattttaatattaggattcgggggggggtaggaggtgtgggcgttaggcgttgtttgtgggcgttcgttcgagttcgagttttttaggagtttgtcggtcgcgtttgtgagtcgtttatttttaggattttcgaggcggttttgcgtcgggtttttaggagttgtttcgattcggaggggtcgcgtgtttttttcggttttttggggagtttttgtatttttttatttttcgtttgatttagcggttcgcgttcgttattcgggagtttgttttttttttttttttttttttttaatttttttttttagtaatttttatggttcgtttcgttcgtttcgatttttttttttttttaaattcgtttcgttttttcgaagtttttatttttaatttcgacgttttagtagaattttttttttttttttttttttggtaattatttggggttgttttagattatttcgtttaaaagcgaggtttcgcgggtttttcggtttttagtttggttcgtcgcgcgtttcgcgtttcgttcgtttcggtcgttttttttatttcgttcgttttttttatttcgttcgtttcggtcgtttcgttcgtttagttcgtttcgttcgcgagtagcggagtcgtttggtcgcgttagttttcgttcgagtcggaaaagggttttggcgagcgcggttcgggtttcggaggcggttggcgtttttttggttgggcgtaattttttttgtttcgaagagttgagttagttttagtgttagagattcgtacgtattgaacgtgggtagaaattttcgtgaaagatgtttatataggaggcggttgcgatttttgttcggacgtagtgatttttaaggaagtaaaatataagaaaatagaaattaataaattgttacgatttttattttgttttatttatttatatttttagttatttatttttttttcgttaattttttgttttttatttggaattatttgttattaattttagaaattttattgaaaataaaaattaaaagttcgagtttgttataaatgaggtttgaaaatttaatttttttttatatttaaaacgagaaaagtttttgattttattagaatttcgattttttttgagagcgtgtttatatttagtagtattatattttttattagagtttaaaagggtggggtggggtggggggaggcgaggaaaagggaaagaaaaataaaataaataaaaatatttttaaattaaagttgttagattttagttttaaagtttttttttagagtagcgaagttttttttagttagtttttttaaaagttaaaaaaagttgagaaaatcgatcggaaatttacgagtaaatagtttaaaaatatatattatttggggtattaagaagtttaaattttttatttgtaaagttttaaggtgtatttgggggtgtcgatttattttatagatattttcgtatttgatattttttataagtttttagagtatgatggtagtttggtttttaggaggtgagtgtatttatgtgaggagtagatgtttggttttttaggatttcgttgtttgtaatgatttatttataattggaaatgggggatatatattaaattcgacgttttttttttatcgtaatttatatttgttgttttaaataataggttggataagtaagttttagtaaagagaaaaaatattattgtatatataggagttagatgtaatttatagatatatatattataaaaattataaattcgtatttatatttagatatttatatatagttatataagtatttttgggttatatagtttgtagattttaaatgtgtatttaataaagagttgtttagggtgattaatataatatatatattttataatttttatatcgaaaatgatatattattgtagttattaattgaagtttttgtaatttataatgagaaattaggggttattagttttttattttttatgtagattttaaagggggatatttattaagatttttaaatataaaagtttttttttatttatgtatgtttcggaagagagtattttgaaaggttggatatgggggattttaaggattatttttgtgttgatggttatataatttttttttttttaattttatttttgttattatagaataaaaaagttagttatcgttgatgattatttttaatattttttggttattttatttaaaatttttggaaatttaaatatattttagtttgtgttgtttgttattttaggtgttgtttgtatgtatttttaacggattttatgtattattttttttggttggagtttttattttattaagttttttttagatgttggaagtaacgtacgtatacgtttagataaggttaattttgagttttttttgtagaggttaaggatattttatatttgtatttgttgtgtatgatttgtaagtggttttaattatggagagttaagaaagggttattcgaatttttgaaaaggtttaagtagaatgtttttaaagagatagtgaaaaatattttagtgtatgtggagtttttttttttttttgtataattttttttaataagatgatttatatagtttttaaaaaggaaaatattattagtaataagaataatattaattagatttagaaaatgggtattatttaaggcgtagggattttgaattttattatgaaatgaatatttatttgtttttttgtttttttttttttattttttttgtttttttatttttttttagggtgcggagagttttttatagtcggaatagacgtttagaagaggatttttgcgtttgggatagaaaagaaatgttaggagggatcgaggagggatggggtaatttggggtggaagttattaagtttggtgagagtgaatttgtaaagggtgattgtttttaaatttaggattgttgtgtgtagttttgcgcgaatagggatggacgttgtttgagtatagggtttcggataattttgttggacgtcgatttaattaaaattaaggagaagttttatgaattgtagaataaataattttgtagatttttaatttaatttttaaagataagttaaaggaaaagaatataaagaaggtgttttagaaggaattttagaaataaattttttattttcggttgaattttttatgtttcgtttttttttttttttttttttttttttttgtttttttttttttttttttttattttttttttcgtttttttttttttttttttatttttttttttttttttaaatgttaattttaaattatatataatttatatagattttttattaggagtattagtaaagatttttttttttgtttttagagttagttaggagatgagaagggattttttttaattttattgtgtggtgggatttgaaacgggttttatattttttgatttttagaattaaaattagtgttagattaataatttgaaagataaatattatagatttggaagtttagattttttaggtataagatatttaattaatggaaataattgtttttttttttttaaattaataattttgttattgttattatttaaagattattataatttaaataaaatgtatttggaaaaattttattttttttttttaaatgtttttaatattttttaatatttttttggtatattattgtttagtttaaaataaataaattttgagatttaataaaataaaatttgtaagagataattttatatataaattaaaataatataaggtattgtgttagtataattattttatagttttatatatgaataattttaaattttttatgtgtaattttattttatgttagtattaggtattttttaaagtggaaatattttgagatatttggttaaaatttaagttttttaggaaatttgaaaaataataaatttggttttattaagaatgaagtataaatttaaaaatatatatatatatatagagaaatatttttaaaatatataattataattaaaattttagttattttttttaacgtgggcgttattcgaaaagttttagatattgtaaggtaaatcgtttttacggatcgttttttgttattgaacgggtaatagcgttttttgtcggaattttatagacgtaaattttgtaagtttttttgatttttttttcggtaaaggttttttttcgtttttgaaaatttggtattgagaggaatatttttaaagtttattttttatgatatttattaattttagaaacgatcgttttagtatttaaaaagtttaaacgttcgaagaaacgtataataaaagtttagtcgttacggagaaaattttttttaatttgaatttattttttttgtttttattttttattatttttcgcgttattatttaattatatgacgtagggaaattattttcgtaagaatttagtaaatggaaatataaaggtaaaataaattttggatttgaaggaaattaaacgagtaaaatatgtatttttttcgttattttattttgttttatgtttatattttttttttaggttacgtatatgtttttttaggtggaatcgtatttgagatattttagatagttaatattcgtattttttttttttatttgtatttattttagtttaaaatagtaaagaaaagaattatttatatttttttttttttttagttttatatagagggaatattatttagtaaatgtcggagtttataattaaaagtaaatgtatttagtatgaagttttttgttggtgattttcgaagtatgtttaggattgttttttaaaaaatgtatagaaaaatattattattaaattaaggttaattaggagtatttttatgtttttttttattttttttttaaaaatttaattatgaattatttaaatttatttgatttttttttttttattagtttttatttttgtatttgtgggttaatattttatgaattatttttttttgtagatgtttattgtattattttttttttttttattatatagtttttttgggttttttttttttatttatttaacgtataaaaataataaaattagaaaagttaagaattagaattattgtgttaagtttgtattttggttttttttattttaggcggtggggtaggttatttaatagtttgaggtttagtgtattgaattataaaatggaaatgattgtgaaaatttattaaaatagtatttgtgggtaaatatatgtggtattattgttttataaataatttaatttattattattgttttaaaatatttagcggggggttaggaaagtggaggtttttaaaaattagggatttgtaataaatttttggttagaaagtggaggtgggaaatttaatataggtttttagattgtgtatttaacgttttgtttatagttttatgatgttgttttatttttttttttttgaagttaagaagatagtatttttggattattgagtatgtttagggttattttttatagttttggatttataagtaggtaaaggaaagaagagaggaaggaaaaattgttttattttagtatttttagatattgttttattttttatttattagaagtattattgtttgttgagttgaataataagatacgatatttatataatagattttgataagttaaaaaatgataaaatatgatagttttattttttattgttgtagtttggtttttaatttttttattatgtttttgttttaagtttttttatgattatatttttggggaagatttagtaggtgtttttattattaatttggaaataaaatattgttgaatgtttgaaattataatttaagtatttgtttttagatttttagggttttgatattatataggttttagtgatttggtatgaggaaataaaataggagggattaatgtttgtataggagtgtttttaaaaaatgaaatgtgggtggggttatttttagattgattttttataattatcgagattgaggtaagtattaaataggaaagagtattttttattttaattataatatttagttgatggtatatttgtaaatttgtaaaagatattgagttgaaattatttgtgagaataaaaataattgtaattgtgaaaatttattttttttttgggatttttgaggagtaatagtaattttattatagattttagatgttttgatttttttaagtttttttgtttaattacgggggtatgaagtggttaaggggatagttttgaaatttttattttttggaggtaaagaggttaaggaaaggaagatgaggggttgaagtaaatgatgtaaatagttatgtaataattgtttttaatattaatgggtattttatatttaaaatgtgagaggtgtgtgttttttttgttatgattaatgtaggaggataggtatttttattattgtggatgttttttatattattgttttaagaaggagaaattttgaagggtgagaatatt

SEQ ID NO: 161 - DNA, 15306 bp, Artificial Sequence
  chemically treated genomic DNA (Homo sapiens)
tattagaaattaatgttgaattagtttttgaatgtttatttttttaatttttgagatagttttaatttgtcgtttaggttggagtatagtggtgcgatttttattattgtaatttttgtttttcgggtttaagtgagttttttgttttagttttttgagtagttgggattataggtatttgttattatgttcggttaatttttgtgtttttagtagagatagttttattatgttggttaggttggtttcgaatttttgattttaagtgatttgtttgtttttgttttttaaagtgttgggattataggtatgaattattacgtttggtttagtttttgaatttttaaaattttattattattattattattattattattattattattttatggatggagtttcgttttgttattaaggttggagtgtagtggtgcgatttcggtttattgtaatttttatttttcgggtttaagcgatttttttgttttagttttttaagtagttgtgattataggtgtttattattatgtttggttaattttttttgtatttttagtagagatggggttttattatgttagttagggtggttttaattttttgatttcgtgatttatttattttggatttttagttaaaatgtattgttaagatagggttttatattgttgtttagtttgaagggttatggcgtgattatagtttattgtagttttgaatttttgggtttaattaatttttttgttttagttttttaagtagttgggattttaggtatgtattatcgtgttagtttaatttttttttatttttttgtaaagatagtatttagttatgttgtttaggttggtttttaatttttggttttaagggatttttttgtttcggttttttaaagtgttgagattataagtgtgagatattgtgtttggttattatttgaatttaaagttaaggattagtaatagtgttttggagagttatattgaagtttgagggaaagggaaaaattagtaatattgagatagttattaaaatgtggagagtgtgtttagtatggatttttggtagtaatttattttattttattttattattttatttatgtattattttattgagatagggttttgttgtgttatttaggttggagtgtagcggtacgattatagtttattgtagttttaatttttttgggtttaagtaatttttttattttattttttcgaatagttgggattatattattacgataagttaatttttttatattttttatagagatggtgttttattacgttgtttaggttggttttgaatttttgagttaaagtaatttatttatttgggtttttcgaagtgttgggattataggtatgagttattgtgtttagttaattttgatgttttaaaatgttaaattaagacgtaatttgaggttgggcgcggtggtttatgtttgtaatttttgtattttgggagattaagattggtggattatttgaggttaggagtttaagattagtttgggtaatatggtgagattttatttttataaaaattgtaaaaaatatttgggtatggtggcgtatttttgtagttttagtaatttaggaggttgagggacgagaattatttgaattcgggaggcggaggttgtcgtgagtcgagattgcgttattggattttagcgtgggtgatagagcgagattttgttttaaaaaaaaataataataataataaagaaaatttaatataatttattttgggtgttgaaatttttgttatttttttatattttgcgatgttaatttttgttttaggaattagattttgtgtgggtttagaaatgatttttaagataaatgaaaaagtaggtttttgttattttttggtcggattttaaatgtcgttgttttgcgggggtttttttgatttattaggagaggggatgagtgtttattatttagtttagtgtgggtagttagttttcgggtttgtttgggttatttatttgtgtttagggttttttttttattttttttgttaaggttgtttttagggatattagttttgtagattattttttgtagtttatatatgtgtttagttttgtattatttttcgtgtagagagaaaagagtaaaagtatagtttttcgtttttgggagataaaattggattaaggaggttaggtgtagtagtttatgtttgtaattttagtattttgggaggcggaggtaggtggattacgaggttaggagttcgagattagtttggttaatatagtgaaatttcgtttttattaaaaatatataaaaattagttaggtttggtggtaggcgtttgtaattttagttatttgggaggttgaggtaggagaataggagaatcgtttaaatttgggaggtagaggttttagtgagtcgagatcgcgttattgtattttagtttgggcgatagtgtgagatttcgttttaaaaaaaaaaaaaaaaaaaaaaaaaaaaaaattgaattagggagatagttagagaatattttgaaggttatatataattaagtatgatagaatgttttgttttggaaaataataaaagtaagtataaaataaggttttgattagaggtgaggtgtggtaggtgggaggatgagtgtgatataaagaattagggttttttgtagttagtatttttgagtgtatttttgtttgtagttgtgagtttttgtttttttatgtgtaaaatgagaggataaggagatagtaatgtattagaatagtttgtttattgttgggtgaggtggttgatgtttgtaattttggtattttgggggatcggggtgggtagatcgtttgaggttaggagtttgagattagtttggttaatagggtaaaattttatttgtattaaaaatataaaaattagtcgggtttggtggtgtgtgtttgtaattatagttatttgggaggttgaggtagaagaattatttgaatttaggaggcggaggttgtagtgagtcgagatcgtgttattgtattttagtttgggtgataaagtaagatttcgttttaaaaaataaaataaaataaaataaaaaaaagaatagtttgtttattaagggtagttaaaaataggttttttattagggttatttatggtttatgtttgtaattttagtaatttgggaggtagaggtaggattttttgagttttaggagtttaagattaggttgggtaatatagtgagatttttatttttatttgttgaaaaatagtaaaaaggtttttttttttttttttttttttgagacggagttttatttttgttgtttaggttggagtgtaatgatatgattttattttattgtaatttttatttttcgggtttaagcgatttttttgttttagtttttcgagtagttgagattataggtatgagaagttaggttttcggttaattttgtatttttagtagagacggggtttttttatgttggttaggttggtttcgaattttcgattttaggtgatttattcgttttagttttttaaagtgttgagattataggcgtgagttaacgcgtttagtcgaaagtttttttttttttaagtagaaatatagtaagttttttagagatttttttttggttaagtggtttgggatttttttttagagaaattgtttaataggttgttttaaggattggagagcgtgtatgtaaaattgttcggtatttatcgggtgttggtaatatttaataataatattttttaataataatagtaattattgttattagtaggaataagttaaattaggaggcgcgatttaggcggaatttggaaggcggtgggtaggatttaggatattttaaggtaggcgtgggttttttgagttaggagttaattttttaggagttaggggagggtttggggtcggaaggtgcggcgtgcgagcggaggacggaagttcgtcgttagggttttcgtttttgttttaagtcgttatttttttttggggagcgtattttggcggaggggtaagttttatacgggttttgttatgaatgggaagttgtagtttttagttcgcggagggaatagtgcgggtttgggggaatagtaggggattcggtagtaattagtagattttttcgtagcgttggtagtttgcgttcgggggtcgttgtcgtttaggttcgtttttatttttttttttttgtcggggttttcggttttttagggcggttttagtattcgaggcgttttttgtcgtttcgtcgtcgggtttaagatttttaggattcggagtttcggtcgtgcggttagttaagtaaggcgggagggaggaagttggtcggttttcgaagttagtttcgagttatatgtgggaagcggtggttgtgacgtaagtttttagggggttttgggttcggttcgaagggagtatatcggagaggtttcgtttcgtgtagttgtaatggtgaaaaagtagaagttttaagcgcgaattttaggtcgttttttttgttgtcgttgtacgttcgatttagtcgcgtttttttttttttgcgggtcggtcgagcgcgcggattttgttttgggttagtcgttgttggatttcgggttgtacgggttgggttttttgcgcggtggttggttttttttttttttttttttgtaacgtttgttaatttgttagttgatggattttattatttatagtggcgtatgtagttcggtcgtagttcgttttatttacgtcgcgtttcgtaagttcgttcgcggttttcggttttttgcgtttcgcgagaggtttgtagatttcggttgtagtcggttttcgggggttcgcgtttttttcgtttcggtttcgcgtcgttcggggggcgttgtaaatagttttttgtttatatgtaattttttatttcgcggaaggaggtcgggggagtgttgagtttttattagttgtttttcgttttgaaatagatatttgattagttgtaaatatatatatatatatatatatatatatatatatatatatatatatatacgttcggggaggtaggtcggagagatttttttttcgtttttttcgttcgttttttttttttcgtcgtcgtcgtcgtcgttagtatttgggatcggtcgattttgtattttcgttcggcgttgttttttgattcggatttttattttgtatttttcggttgatcgcgggatttggttcgtgtagaggaggggggtcgatcgttatggagtattttatggtgtttatttagaaggtgttttttttgtaatattttaggaaaatagagaaagaagtgataggagggttttgtaggtgtgtattttttttttttttattttttttttattattgtagttttcggttagttcgttcgggcgggcgcgcgtgtgcgtacgtatggttcgcgtcgtcgatttcgttagttttttttagttgtcgggacggttgtagttttatacgtcgggttcgcgtcgtttcgggattttttttttttggagtatgggggttttaagcggtttcggttatttttgttcgttgtaggcgggcgagtcgcgacgtttgtaaattgtaaatagatttacgtggttttgtagtagtttcggttatgtttggtgttggtggttttttttttcgcgtttttttttttttttttttgcggcggtttttttttttttttttttttttcgggatttgaggtcgtttttatttaagggggtttgggggttcggggcgcgcgtgggggtgtagttagggcggttataatgtagttatgtcgcggttttcggcgcggggtgggggcggggagtcgggtattgtgcgtgtttgtagagcggggttgtagcggggtcgggggcgtgttcgcgtgtgggtgttgggggtgggcggatttcgaggggttcgcgcggtcggtaggggcgtcgcggttcggggtacgttggttgtcgttcgttcgttcgttcgcgttcgggcgttgtttattagcgaggtttggacgtgattttgtagtttttttggagtaggcggatttttgcgcgcggtttcgcgggagttgtagtttttcgtgttttgttggtgtagtattgtgggatttgtaggcgtttttgggttacgttttttttgtataaagttcggttttcgcgggtacgatgggtaaggtaggttaggtgggtaggttatttggggaagggatatttgaggtcgtttttagtttcgtagggtagtttttcgtcgtacgtgggttttttttgtaaatttttttatttaacgttttttttttttgtcgtaaatcgaaagcgtcgggttttttagtcgggtgggtggttcgaggttcgtaggtttttttagaagttattttgtaagttttggatttaggttgttttaaatttaaagggtgatggatttaaggattatatatagttaaattatttcgtatattttttaaaatgtatatgtttggaattttgatcgttggggttcggatatttgtattttgaacgattttttgggcgtggtgtgggggaggtgggcgttttacggcgtgcgtaagtttgggatttgtggttttttttttgtcgcgttgttttaggagcgaaatggttttttagggttggagttacgtgttttgtcgttcgaggtagtttgggcggggattgagggaggaggagttcgtcggtgtggtataggttggtggacgttagcgtttgtagaattcggtttggagggaaggttgttgtatacgtgtagatatttttgtttaattttttgtttcgggggtttttattttaaggttattttgaagtttttagttaatatttagatttgggttagttgatgggtttggtagttggtagggatgtttcgagggttggtttttgtacgaggtttatttggagggtttagtaataataagtaaaaaaaatttttgagttttttttatgttttggggatttattttgttagaatttttttattgagttgttataatttttttatgagttaaaagtgttttttgatttcgtttaaagaggcggatatagagattggagaagggattattatagtaggtggtggaattggaatttgaatttttgttttggggttgttgttgttgtagggttgggttgggtagcgcggaggtgtagttgagtcgttgtgtttattggagaagatattttgggtttgattttgggtagggttggggggttttttggttgttatgtttgggttttgggtgagtttttttagggttttttgagattttggttttaatttatttttgttttaagcgtttttttggaggatattagtagttttttagggtagttggattttggtaggttaaggatttgaaggtgtagggttttcgtttagggttggatatggtaacgtttattgtaagatagttgttagttgtgtattaggtatggagttgggggtttttggatttgtttatttttagtaggggttgtagggtgaggtgggaagttagtttgggattaaatgtgtttattaggtaggattttttggttagatgtatttgttttttagggttattttaggttggtgggttttgttttattttttagtgattagtagggatttttttgtttttttgttttttaggtttgttagaggggattgtagggtacggtgttgtatatataagttgtaggttttggatttgtcgtttaatggtttttagtttttgggaaatagagtatttgtgagaaaattagttatgggtatggtaagtgtttggtagttgtaaaaatgatatttagtttttttttttttgagacggagttttattttgttatttagaatggagtgtaattttggtttattgtaattttcgttttttagatttaatcgatttttttgttttagttttttaagtagttgggattataggtatgtgttagtatgtttggttaatttttttatttttagtagagatggggttttattatagtggttggttaggttggtttcgaatttttgattttaggtgatttgtttattttggttttttaaagtattaggattataggtatgagtaattgcgtttagttattgagttttaaaagtaggtatatgggtaggtatatggtagtttttatttatattttgtgttttgtttgtttgtttgtttgttttgagatggatttttattttgtcgtataggttggagtgtagtggcgtaatttcggtttattgtaatttttgttttcggggtttaagtaatttttttgttttagttttttaagtaattgggattataggttcgttttattatggtcggttaatttttgtatttttagtatagacggggttttattattttggttaggatggtttcgattttttgattttatgatttgttcgtttcgtttttttaaagtgttgtgattttagacgtgagttatcgtgttcggattttttatttgtattttttttttttttttttttttttttgaggtagagtttcgttttgtcgtttaggttggagtgtagtggtgtaatttcggtttattgtaagttcggtttttcgggtttacgttatttttttgttttagtttttcgagtagttgggattataggcgtttattattacgttcggttaattttttgtattttaattagagataggtttttattgtgttagttaggatggtttcgattttttgatttcgtgatttgtttatttcggttttttaaagtgttgggattataggcgtgagttatcgcgtttggtttttgtttgtattataaagtttttaggtttggttcggtggtttaagtttgtaattttagtgttttggaaggttaaggggaaaaaattatttgagtttaggagttcgagattagtttgggtaatatagtaagattttatttttataaaaaataaaaaaattagttcggtatggtggtatgtgtttgtagttttagttttttgggaggttgaggtaggaggatggtttgagtttgggaattggagattgtagtgagttatgattatagtattgtattttagtttgggtaatagagattttgttttttaaaaaaaatagtaagattgggtgtagtggtttatttttgtaattttagtattttgggagattaaggcgggaggattatttgagtttaggagttcgagattagttttagtaatatgacgaaattttgtttttattaaaaatataaaaaattagtcgggtgtgaatggtgtgtatttatatttttagttgtttgggaggttgaggaaggaggacgatttgggtttaagaagttgaggttatagtaagtcgagattatgttattgtattttagtttgggtgacgggagtgagattttgtttttaaataaataaataaaaataaattaaaaaaataataaaatttaaaaagtttttataagaaggagtttaagaaaattgaaggttttggagtgtttattgggtttttgatttatttatgaagtaataatattttgtcgggattgaggatatagttacgaataggatgtgatttttgtttttagtagtttatagttttgtggttttaaaaggttttgtagattttttaagagttttatgggttgttttggatatttgggtgtaaattaatttttgggtttcgatttttcgagtagttgggattatagatacgttttataatattcggttaatttttgtatttttagtagagagggggttttattattttggtttggttggtttgaaatttttgattttaggtgattcgtttattttagttttttaaagtgttgggattataggtatgagttatcgtgtttggttttttttgattttttttaaattttattatgattttgtgaagtgaagtagtgtttttatattttatagacggaggaaatcgaggtttggtgttgtatagttagtaagtggtaaggttggatttttttatttgagtttagtgtagggtttttattgatgggttggaggagttttggggaagggagggaggtagggatgtttttgatggtaatagtttgggtatggtgtgttttgggatcgaggggaagggtagtagattggttaggttagagtatagagtatgggtgagtagtgtagaagtagcggggatggagtatggatgagaatttcgggttgattatgttagagaaggatgagtgttttagtgtttttttgggtttgggagaatttcgtgtggatttttttacgttgattgtgtagatgttaagtgattttgaggtatgtgagtgattttagggtagtgtgaaatgaaagtttttagtggtcggtttgaggttggagttgggtaggtaggtgtagagggattgggggtatttgattttggtttgggtaggagggataggtatttggtagggttttagatttgaagggtatgttttatgtttttaagtgtttggttgggacgttagcgttagttttagtagattttgtgggtgttgtggtggtaggtgtggcggtttttgttttagtatttaaggttggtgtttaaattttgttttttggttattggttgtttagtgattttatttttaaatttagggtagtttttgtttggatttaggaggttggtttgtaagaagtaagagagttttggtgtggttgggtatggtggtttatgtttataattttagtattttgggaggtcgaggcggatggattatttgaggttaatagttcgagattagtttgattaatatggtgaaattttatttttattaaaaatataaaaattagtcgggcgtggtggtgggtttttgtaattttagttattcgggaggttgaggtatgagaattgtttgaattcgggaggtagaaattgtagtgagttgagattgtgttattgtattttagtttgggtaatagagcgagattttattttaatttttttttcgttttttataattagttaggtttggtggattacgtttgtaattttagttatttgggaggttgaggtatgaaaatcgtttgaattcgggaggtagagattgtagtgagttaagattgtgttattgtattttagtttgggtaatagagcgagatttagttaaaagaaaaaagagaatttcggtgttggtggatttgggttatttttgatttttatttggaggagtttgaagtggttagagagaggatagtggatttttattgtgtgtgtaggacgtttatagattttaatcgtaaatgtaaaattttagaaagagttattagaaatttttaggtatttgtagaaaaatttattttatttagtgtagtattatttggaaattttaattaattattttttattaataggaatttttggttggttagttattagaagttttggttggttagtattttattaataagaatttttggttagcggtattttattaattataatttttggttagtttttattttattaattagaagttttggttagaatgtattttattaaaggattttgtcggcgggtatttttagggtaatttaggtgagttatatttgagggttttggtggtagatttaggttttacgaggaattgtattttttggggggaaatttgtttttttggatttaagaaagtgtttaatttaagttaagtattaggttagttagtagttggtttttgagttaggagattgggttgatggttttggagaggaaggaggtaggatggagtattggagaagttgggtcggtagattttgatgtagaggaggaggcgatataggtttttgattttagttttagttttttttttttgtgagaatttttggttggggttttcgggattggggtttggtggttttttttggttttttagttagtgggttgttttgcggggaagggacggaagaggttgagggttagtttttaagagtagaggagttggtgggatttgggtcgggaggtgtagaagggtgtatttggttgtattttgttttgtttagttgttgggtgtgattttgggtaagttattttatttgtgggtttgtgtttagaggggtaggggtgatggttgagtttgtagttatatattcgtttttgataagtggcgggttgtgtgaattagtagttagtagaggcgttttagtgggttggtatttgtaggttgttgttgtgttaggtttggttatttgattttgggattattatttttttttttacgattttgtattgtttgtttattgtaatttcggttattttattgggttttgtgagaattaggtagggaaaaatgttaacgaggtttgtgaataataaaaagagttatacgattatagcgattttcgaatgtttggtttttttttttttttttttttttttttttttttgagataaggttttattttgttgtttaggttggagtatagtgatatgattatagtttattgtagttttaattttttgggtttattatatttttttattttagtttttttagttgttggaataatagggatattttattatgtttggttgattaattttttttagtgatggggttttattatgttgtttaggttggttttgaattttggggtttaagcgatttttttattttggttttttaaagtgttaggattataggtgtgagttattgtgttcggtttagtttttttttttatagggataattgttatttgttagttggggtatttggttttgtgggtcggttagagtttattttgttttatggtttgatatttgttttggggttagggtttacgtttagcgtttgttgtagttggattttatttaaatttttgtgtttttttttttatatgggagtttttaggttatttgatttaggaatattgtgataatttagtgagaaaattttcgttaaaaatttaaaaaaaaaaatgtatttttttgttgtggattttttaggagggttagtttttaggtggtttaaggttggatttggtgttttttttttattttttagttagttttggtttttgggtattgttaggagggatttaggggttgggtgggtaggggtttttttttatattttttttgagggggatggtgatgttttaagattgtatttattttgtgttgtggttttttatggatatttttttttattttttatttttaaagagttttagttttaagttatttattgtagagtagttttggtttttttggtttgttggttttttagatatggtatggtttgagtttgtgttaggtttgggagtttggatttcgttttaaggttgggttatatatagtcgtgtagtaggtttgttttagtttttttattatttttattttagggtaggggaatcgggagaagtgagagtattgatatttagttgatcgattttaaaattattttttttttgttttgtattttaaagttttatggaaagtggggggttcgggttttttttgtagtgttgatattttaagattttgtaagagatttgtattttgggtgtaggttttgggtttttgggttttgatggaggagggggtttggtttgatgaggacggaaggaggttgatttgtatttagattttcggcgttggatatttttttattgggagaggaagtcgaggtcggggaaggggtagcgatgcgtttagggttttatagggagttaaggttggatagatgggtaggttgggtggggttaggaaggttacggttgtttttagttgttgtagatgtgttgttttcggggttcgtgtaaattttttttcgtttgtaggttggcgaaggggttagggtatatagtaggggagttagatttggtagttttttgattttagattgtttttattaatggagtaggagttgtttagaattttttttttgtttttttatatttaggggtatgagtttttttggtttagttttggaatagggtatttcgggagggttttttaggaagaggtcggggttgcggtttcgggtggggtcggtagtttttgttgagagtttagtatttggaagttattaggttaggggcggggggagttgtaggggaggtttagggagggggatatgttttttttaggttatatataagtttaattttcgggagcgtggttttgggtttataatcgttgtttttgtattttggttcgtagtttcgttttttggcgtatacgtttcgttttcgttcgaagttacgtttttagttagtagttacgttttttttttttaggttgtttttttatcgtattggttattgtttttgtaagggttagtagcgttttttatagtatggtgggagtttcgttttttcggcgtagggtgggtttattttttggagtgggtgggttgtggggagtcgtgtttttaggggttgttggtttggtgtttttttggggagtgagtggtatttgttttttgtgaagttttagtttagcggggttggggtttgtggtgggaggcgtggtcgtgagggtaggaagggagtggggacgttttttttagttttggggtggtaaagtttgagacgttgaagaggcgttttaggtgtttagtaaattatttagaagtgttttaggagcggggatagcgtttttgaatgtcgtttgtatttcgcgtgtattagaattatattacgtacgtttttgggttttatcgggtttgttagttagacgttggggttagtattcgtcgtttgtatagtttttaagtttttggatgttttgatgtttagatatattgggaattttgtttcggaggagagattgttttttgtgaggaaagttagggaggggatgggtttttgttgttgttgttgagataaggttttgttttgttgtttagattgaagtgtagtggcgtgattatagtttattgtagtttttaatttttgggtttaagcgatttttttattttagttttttgagtagttgggattataggtatgtattattatatttggttaattttatttttttgtagagatagggttttattacgttgtttaggttgattttaaatttttaggtttaatgatttttggttttgattttttaaagaattgggattattgtgtttggttcggggtgggttttgagcggattattttattcgtagttagttgatttagttcgtttcggtgttttagagagtatttttttattattttttgggggtggtttggtattttttgtagtaggggagggatgtagtttttattggggttttttggagatgaatgatgaagagggcgttttggtcgagtttgtttttgttttttttggtagt

SEQ ID NO: 162 - DNA, 15306 bp, Artificial Sequence
  chemically treated genomic DNA (Homo sapiens)
gttgttagagaggatagggataggttcggttaaggcgttttttttattatttatttttagagggttttagtggaaattgtattttttttttgttgtaaaagatgttaggttatttttagagagtgatggaggggtgttttttgggatatcggggcggattgaattagttggttgcgggtaagatagttcgtttagaatttatttcgggttaggtatagtaattttagttttttgggaggttaaggttaaggattattgagtttaagagtttgagattagtttaggtaacgtagtgagattttgtttttataaaaaaataaaattagttaggtgtggtggtgtatgtttgtagttttagttatttaggaggttgaagtgggaggatcgtttgagtttaggagttggaggttgtagtgagttatgattacgttattgtattttagtttgggtaatagagtaagattttgttttaataataataataaaaatttattttttttttggttttttttatagggagtagtttttttttcggaatagaatttttagtgtgtttgagtattaaaatatttaagagtttagaaattatgtagacgacgggtgttggttttagcgtttgattagtaggttcggtggggtttagaaacgtgcgtggtgtgattttgatgtacgcgggatgtagacgatatttagggacgttgttttcgtttttggaatatttttgagtgatttgttaggtatttggagcgtttttttagcgttttaggttttgttattttaggattgaggaagacgtttttattttttttttatttttacggttacgttttttattataagttttagtttcgttaggttaagattttatagaagataagtattatttattttttaaaaagatattaagttaataatttttggggatacggttttttatagtttatttattttaagagatagatttattttgcgtcggagaagcgaggtttttattatgttgtggggagcgttgttgatttttgtaggagtagtggttagtgcggtgagaaggtagtttgggggaagagggcgtggttgttggttgggggcgtggtttcggacgagggcggggcgtgtgcgttagggggcggggttgcgggttagggtgtagaggtagcggttgtgggtttaaggttacgttttcgagggttgggtttgtgtgtggtttggaggaggtatgtttttttttttggattttttttgtaatttttttcgtttttggtttgatggtttttagatgttgggtttttagtagaggttgtcggttttattcgaagtcgtagtttcggtttttttttgaggggttttttcggggtgttttgttttaggattgggttaagggggtttatgtttttgaatgtgggagaataggaaaagggttttgggtagtttttgttttattgatgaaggtagtttggggttaaggggttgttaagtttaatttttttgttgtgtgttttggttttttcgttagtttgtaggcggaaaggagtttgtacggatttcggaggtagtatatttgtaatagttggaaatagtcgtggtttttttggttttatttagtttgtttatttgtttagttttggttttttgtgggattttggacgtatcgttgtttttttttcggtttcggtttttttttttaatagagaggtgtttaacgtcggaagtttggatgtaaattagttttttttcgtttttattaagttaagtttttttttttattaggatttaaaggtttagggtttgtatttagggtataagttttttatagggttttgaaatgttagtattgtaaaaggggttcgggttttttattttttatgagattttagggtgtagggtagagaggggatggttttagggtcggttagttggatgttagtgtttttatttttttcggtttttttgttttgaagtggaggtgatagggggattggagtaggtttgttgtacggttgtgtgtggtttagttttagggcggagtttaggtttttaggtttggtataaatttagattatattatgtttgagaggttagtaggttaaggggattaggattgttttgtagtgggtggtttaaagttggggttttttggaggtaagaggtgggaagagatgtttataggaagttataatataaggtaagtgtaattttgaggtattattattttttttaggagagatgtggggagagatttttgtttatttagtttttgggttttttttggtaatgtttaaaagttagagttgattagggggtgaaaagggagtattaagtttagttttgggttatttgagagttggtttttttggagggtttataatagagggatatatttttttttttaagtttttggcgagaatttttttattgaattgttataatgtttttgagttaggtggtttgaagatttttatgtaaagaggggggtatagaggtttgggtagggtttagttgtagtaagcgttgggcgtgaattttgattttagagtaggtgttaggttatagggtagaatgagttttgatcggtttatagagttagatgttttaattggtaggtgatagttatttttgtaaaagagaagattaggtcgggtatagtggtttatatttataattttagtattttgggaggttaaagtaggaggatcgtttgagttttagagtttaagattagtttgggtaatatagtgagattttattattagaaaaaattaattagttaggtatggtggagtgtttttattgttttagtaattgaggaggttaaggtgggaggatgtaataagtttaggaggttgaggttgtagtgagttgtgattatgttattgtattttagtttgggtaatagagtgagattttgttttaaaaaaaaaaaaaaaaaaaaaaaaaaaaaaggattaggtattcggaaatcgttgtaatcgtgtaattttttttattatttatagatttcgttgatatttttttttgtttgatttttataaaatttagtggggtggtcgagattatagtgagtaagtaatgtagggtcgtgggaaggaaggtgatgattttaaggttaagtagttagatttggtataatagtaatttgtagatgttaatttattgaagcgtttttattgattgttagtttatatagttcgttatttattagaagcgggtgtgtgattgtaagtttagttattatttttgtttttttgaatataagtttataagtgaggtgatttgtttaaggttatatttagtagttgggtagggtagggtgtagttagatgtatttttttgtatttttcggtttaagttttattaatttttttgtttttgggagttgatttttagtttttttcgtttttttttcgtaaggtagtttattaattgggagattaaaggagattattagattttagtttcgaaaattttagttagaagtttttataaggaagaggagttggggttgggattaggggtttgtgtcgtttttttttttgtattagaatttgtcggtttagtttttttaatgttttattttgttttttttttttttaaagttattagtttagttttttggtttagaaattagttgttggttaatttagtgtttaatttaggttaagtatttttttaaatttaagaaagtaaatttttttttaaaaggtatagtttttcgtgggatttgaatttgttattaagatttttaaatataatttatttaaattgttttggaagtattcgtcgatagagttttttaatagaatgtattttaattaaggtttttgattggtggaataggagttaattaggggttgtgattggtggagtgtcgttaattaggaatttttattggtggaatgttgattaattagggtttttgatggttgattaattaggggtttttgttgatgaaggatggttgattgaaatttttaggtgatattgtattgaataaagtggatttttttgtaaatgtttgaaagtttttgatagttttttttggggttttgtatttacggttaaggtttgtaaacgttttatatatatagtaaaggtttattattttttttttggttattttagatttttttaggtgaaaattaaaggtgatttaagtttattaatatcgaggttttttttttttttttgattgagtttcgttttattgtttaggttggagtgtagtggtataattttggtttattgtaatttttatttttcgggtttaagcgatttttatgttttagttttttaaataattgggattataggcgtgatttattaagtttggttaattatggggggcggagggggggttgagatggagtttcgttttgttgtttaggttagagtgtagtagtataattttagtttattgtaatttttatttttcgagtttaagtaatttttatgttttagtttttcgagtagttgggattatagggatttattattacgttcggttaatttttgtatttttagtagagatggggttttattatgttggttaggttggtttcgaattgttgattttaaatgatttattcgtttcggttttttaaagtgttgggattataggtatgagttattatgtttagttatattaaggtttttttgttttttgtaagttagttttttgggtttaaataggggttgttttagatttaggaataaggttattgagtagttaatggttaaggaataaaatttgggtattagttttggatgttaaggtaagagtcgttatatttattattatagtatttatagaatttgttgagattgacgttggcgttttaattagatatttggaggtatagggtatgttttttaagtttagaattttgttaggtatttattttttttgtttaggttaaagttaagtatttttaatttttttatatttgtttgtttagttttagttttaaatcggttattgagaatttttattttatattgttttgaagttatttatatattttagggttatttaatatttatatagttaacgtgggaaagtttatacgggatttttttaaatttaaaaaagtattaaggtatttatttttttttaatataattagttcgaggtttttatttatgttttattttcgttgtttttatattatttatttatattttgtattttgatttggttagtttgttgttttttttttcggttttagaatatattatgtttaggttgttgttattagaaatatttttgttttttttttttttttaaagtttttttagtttattagtgggaattttgtattgggtttaagtgaaaaagtttagttttgttatttattagttgtgtaatattaagtttcggtttttttcgtttgtaaaatatggaaatattgttttattttatagggttatggtgaagtttaaaagagattaagaaaggttaggtacggtggtttatgtttgtaattttagtattttgggaggttaaggtgggcggattatttgaggttagaagttttagattagttaggttaagatggtgaaattttttttttattaaaaatataaaaattagtcgggtgttgtgggacgtgtttgtaattttagttattcgggaggtcgaggtttaagagttagtttgtatttaggtgtttaggataatttatgaaatttttagggggtttataagattttttaagattataaggttgtgagttgttgaggataggagttatattttgttcgtggttgtatttttagtttcggtagaatgttgttgttttataaataaattagggatttaataaatattttaaagtttttaatttttttgaatttttttttatgggagttttttaagttttattatttttttaatttatttttatttatttatttagaggtagggttttattttcgttatttaagttggagtgtaatggtatgatttcggtttattgtagttttaattttttgggtttaggtcgttttttttttttagttttttaagtaattgggagtataagtgtatattatttatattcggttagttttttgtatttttagtagaaatagggtttcgttatgttgttgaggttggtttcgaatttttgggtttaagtgattttttcgttttggttttttaaagtgttagggttataagagtgagttattgtatttagttttattgttttttttaagagatagggtttttgttatttaggttagagtgtagtgttatgattatagtttattgtaatttttaatttttaggtttaagttatttttttgttttagttttttaaggagttgagattataggtatatgttattatgtcgggttaatttttttattttttgtagaggtggggttttgttatgttgtttaggttggtttcgaatttttgggtttaaatgattttttttttttggttttttaaagtattgggattataggtttgagttatcgagttaggtttaggagttttatgatatagatagaggttaggcgcggtggtttacgtttgtaattttaatattttgggaggtcgaggtgggtagattacgaggttaggagatcgagattattttggttaatatagtgaaagtttgtttttaattaaaatataaaaaattagtcgggcgtggtggtgggcgtttgtagttttagttattcgggaggttgaggtaggagaatggcgtgaattcgggaggtcgagtttgtagtgagtcgagattgtattattgtattttagtttgggcgatagagcgagattttgttttaaaaaaaaaaaaaaaaaaaaaaaagatatagatggagagttcgggtacggtggtttacgtttgaaattatagtattttgggaggacgaggcgggtagattataagattaggagatcgagattattttggttaaaatggtgaaatttcgtttgtattaaaaatataaaaattagtcggttatggtggagcgggtttgtagttttagttatttaggaggttgaggtaggaaaattgtttgaatttcggaggtagaagttgtagtgagtcgagattgcgttattgtattttagtttgtgcgatagagtgagagtttattttaaaataaataaataaataaataaaatataagatatggatggagattattatatatttgtttatatatttgtttttaagatttagtggttgggcgtagttgtttatgtttgtaattttagtattttgggaggttaaggtgggtagattatttgaggttaggggttcgagattagtttggttaattattatggtgaaattttatttttattaaaaataaaaaaattagttaggtatgttgatatatgtttgtaattttagttatttgggaggttgaggtaggaaagtcggttgaatttaggaggcggaggttgtagtgagttaagattgtattttattttgggtgatagagtgagatttcgttttaaaaaaaaaaagattgagtgttatttttatagttattaggtatttgttatatttatagttaatttttttataggtgttttgttttttagagattgagaattattaggcgataggtttaaaatttgtagtttgtgtgtgtagtatcgtgttttataattttttttggtaggtttgggagatagaaagatagggagatttttgttggttattgagggatggagtaaagtttattagtttgagatgattttgagaagtaaatgtatttggttagaaggttttgtttaatgaatatatttgattttagattggttttttattttattttgtaatttttattgaaggtaaataaatttagggatttttaattttatgtttaatgtatagttgataattgttttgtaatggacgttgttatgtttaattttggacgaaggttttatatttttaagtttttggtttattaagatttagttattttgggggattgttggtattttttaaaggaacgtttggggtagggataaattgaagttagaattttagggggttttgagaggatttatttaaggtttaggtatggtagttagagggttttttaattttgtttaggattaggtttagaatgttttttttagtaggtatagcggtttaattgtattttcgcgttgtttagtttagttttgtagtagtagtaattttaggataagggtttaagttttagttttattatttgttgtagtggttttttttttagtttttgtgttcgtttttttaagcggaattaaaagatatttttgatttatagaaagattatgataatttagtgagaaaattttagtaaagtgagtttttagaatataaaaagagtttaagaattttttttatttattattattgggttttttaggtgggtttcgtgtaagggttagttttcggggtatttttgttagttgttaaatttattaattggtttaagtttaggtattgattgggaattttagagtagttttaaggtggggattttcggggtagagggttgggtaggagtgtttatacgtgtgtagtaattttttttttaggtcggattttgtaggcgttagcgtttattagtttgtgttatatcggcgggtttttttttttttaattttcgtttagattgtttcgggcggtagagtacgtggttttagttttggggagttatttcgtttttggagtagcgcggtaggaaaggggttataggttttaaatttgcgtacgtcgtaggacgtttattttttttatattacgtttagggggtcgtttaaaatgtagatgttcgggttttagcgattagagttttaggtatgtgtattttaagaagtgtgcggggtggtttggttgtgtgtggtttttgagtttattattttttgggtttagagtaatttaggtttaaagtttgtaaagtggtttttggggaggtttgcggatttcgggttatttattcggttgggggattcgacgttttcggtttacggtaggggggaggggcgttggatgggaaagtttgtagaggaaatttacgtgcggcgggaagttgttttgcgaggttaggggcggttttaggtgttttttttttaaatggtttgtttatttggtttgttttgtttatcgtgttcgcgggggtcgagttttgtgtagggaaagcgtggtttaggagcgtttataaattttataatgttgtattagtaggatacggagaattatagttttcgcgaggtcgcgcgtagaggttcgtttattttaagagggttgtagagttacgtttaggtttcgttagtaaatagcgttcgggcgcgggcgggcgagcgagcggtagttaacgtgtttcgggtcgcggcgtttttatcggtcgcgcgggtttttcggggttcgtttatttttaatatttatacgcgagtacgttttcgatttcgttgtagtttcgttttgtaaatacgtatagtgttcggtttttcgtttttatttcgcgtcgggagtcgcggtatggttgtattgtagtcgttttagttatatttttacgcgcgtttcgggtttttagatttttttggatggggacgattttagatttcgaggaaggaaggagaggaaggaagtcgtcgtaggagggggaaagaggaagcgcgggggggaaggttattagtattaagtatggtcgggattgttgtagaattacgtgggtttgtttgtaatttataaacgtcgcgattcgttcgtttgtagcggataaaagtggtcggggtcgtttggggtttttatgttttaaggaaggagggtttcggggcggcgcggattcggcgtgtggggttgtagtcgtttcggtagttaagaaaggttagcggggtcggcggcgcgggttatgcgtgcgtatacgcgcgttcgttcgggcgggttggtcgggggttgtagtggtaggaagggggtggggggaggaggagtatatatttatagagtttttttattatttttttttttgtttttttgaaatgttgtaaagagggtattttttgagtgggtattatgaaatattttatagcgatcggttttttttttttgtacgagttaggtttcgcgattagtcggagaatgtaagatggaaattcgaattaaagggtagcgtcggacggaggtgtagaatcggtcggttttagatgttggcggcggcggcggcggcgaggggagggaggcgggcgggaggggcgggagggaggttttttcggtttgttttttcgggcgtgtgtatgtgtgtgtgtgtgtgtgtgtgtgtgtgtgtgtgtgtgtgtgtttgtagttgattagatgtttgttttaaggcgggaaatagttggtgaaaatttagtattttttcggttttttttcgcggagtaaggaattgtatgtaaataaaggattatttgtagcgtttttcgggcggcgcgaggtcggggcgagaggggcgcgggttttcggggatcggttgtaatcggggtttgtaggtttttcgcggggcgtagggggtcgggggtcgcgggcgggtttgcggggcgcggcgtgaatggagcgagttgcggtcgagttatatgcgttattatgggtgatgaggtttattagttgataggttggtaagcgttgtaaaaaaaaaaaaaaaaaaggttagttatcgcgtagggagtttagttcgtgtagttcggagtttagtagcgattggtttagagtagggttcgcgcgttcggtcggttcgtagggaggagggggcgcggttgggtcgggcgtgtagcggtagtaaggaaggcggtttggggttcgcgtttggggtttttgtttttttattattgtagttgtacggagcggagttttttcggtgtgtttttttcgagtcgagtttagggttttttggaaatttgcgttatagttatcgttttttatatgtaattcggggttgatttcggaggtcggttagttttttttttttcgttttgtttagttggtcgtacggtcgggatttcggattttgggaattttggattcggcgacgggacggtaaagggcgtttcggatgttggggtcgttttaggaagtcgggggtttcggtagggaggggagggtggaggcgggtttgaacggtagcggttttcgggcgtaggttgttagcgttgcggggaggtttgttggttgttgtcgggttttttgttatttttttagattcgtattgtttttttcgcgggttgaaggttgtagttttttatttataataaagttcgtgtgggatttgttttttcgttagggtgcgttttttaagagggggtgacgatttggggtagggacggggattttggcggcgagttttcgtttttcgttcgtacgtcgtatttttcggttttaggtttttttttggtttttggagggttggtttttggtttaggaagtttacgtttgttttggaatgttttggattttgtttatcgttttttaggtttcgtttaaatcgcgttttttaatttgatttatttttattagtaataatagttattgttattattgggaaatattgttattagatgttgttagtattcggtggatgtcgagtagttttgtatatacgttttttaatttttgaagtaatttgttaggtagtttttttaaggagagattttagattatttgattaaaaaaaagtttttggaaggtttattatgtttttatttaaaaaaaaaaaaattttcggttgggcgcgttggtttacgtttgtaattttagtattttgggaggttgaggcgggtggattatttgaggtcgggagttcgagattagtttgattaatatggagaaatttcgtttttattaaaaatgtaaaattagtcgggggtttggttttttatgtttgtaattttagttattcgggaggttgaagtaggagaatcgtttgaattcgggaggtggaggttgtagtgaggtgagattatgttattgtattttagtttgggtaataagagtgaaatttcgttttaaaaaaaaaaaaaaaaaaaaaaatttttttattgttttttaataaatagagataggagttttattgtgttgtttagtttggttttgaatttttgggatttaaggaattttatttttattttttaaattgttgggattataagtatgagttatggatggttttggtgggaagtttatttttaattgtttttagtgagtaagttatttttttttttgttttgttttgttttgttttttaagacggagttttgttttgttatttaggttagagtgtagtggtacgatttcggtttattgtaattttcgttttttgggtttaagtgatttttttgttttagttttttaagtagttgtggttataggtatatattattaagttcggttaatttttgtatttttagtatagatgggattttgttttgttggttaggttggttttaaatttttgattttaggcgatttgtttatttcggttttttaaagtgttaggattataggtattagttattttatttagtagtgagtaagttattttggtgtattattgtttttttatttttttattttgtatatgggaagatagaagtttatagttgtagataagaatgtatttaggagtgttggttgtaaaaagttttggttttttatattatatttatttttttatttgttatattttatttttgattagggttttattttgtatttgtttttgttattttttagagtaaagtattttgttatatttagttatatgtggtttttagagtgttttttggttgtttttttggtttaatttttttttttttttttttttttttttttttgagacggagttttatattgtcgtttaggttggagtgtagtggcgcgatttcggtttattggaatttttattttttaggtttaagcgatttttttgtttttttgttttagttttttaagtagttgagattataggcgtttgttattaggtttggttaatttttgtgtatttttagtagagacgaggttttattatgttggttaggttggtttcgaatttttgatttcgtaatttatttgttttcgttttttaaagtgttgggattataggtatgagttattgtatttggtttttttggtttaattttgttttttagagacgagggattgtgtttttatttttttttttttgtacgggggatggtatagggttgggtatatgtgtgaattgtagagagtgatttgtaaagttgatatttttggagatagttttggtagaaaggatgagagggagattttaggtataagtgggtggtttaggtagattcgggagttggttgtttatattgaattgggtagtaggtatttatttttttttttaataaattaaggaagttttcgtaaagtagcggtatttggagttcggttaggggatggtagagatttgtttttttatttgttttggaagttatttttaggtttatatagaatttggtttttggggtaagagttgatatcgtaaaatgtaagagagtgataaaaattttaatatttaagataaattatgttgggttttttttgttgttattgttgtttttttttgagatagagtttcgttttgttatttacgttggagtttaatggcgtaatttcggtttacggtaattttcgtttttcgggtttaagtgattttcgttttttagttttttgagttgttgggattataggagtgcgttattatgtttaggtattttttgtaatttttgtagagataggattttattatgttgtttaggttggttttgaatttttgattttaagtgatttattagttttggttttttaaagtgtagggattataggtatgagttatcgcgtttagttttaaattacgttttaatttaatattttaaaatattaaaattggttgggtatagtggtttatgtttgtaattttagtatttcgggaggtttaagtgagtggattgttttagtttaggagtttaagattagtttgggtaacgtggtgagatattatttttataaaaaatataaaagaattaatttgtcgtggtgatgtagttttagttgttcgggagggtgaggtgggaggattgtttgagtttagggaggttgaggttgtagtgagttgtgatcgtgtcgttgtattttagtttgggtgatatagtaagattttgttttaataaaataatatataaataaaataataaaataaaataaaataaattattgttaaaaatttatattaaatatattttttatattttaatgattattttagtattattgattttttttttttttttaggttttagtatagttttttaagatattgttgttgatttttagttttaaatttaaataatggttaggtatagtgttttatatttgtaattttagtattttggaagatcgaggtaggaggattttttgaggttaggagttggagattagtttggataatataattagatgttgtttttataaaaaaataaaaaaaaattagattggtacggtggtgtatgtttaaagttttagttatttgggaggttgaggtaggagggttgattgagtttaggagtttaagattatagtgagttatgattacgttatggttttttagattgggtaatagtgtaagattttgttttaataatatattttaattgggagtttaaagtaggtagattacgaggttaggagattgagattattttggttaatatgatgaaattttatttttattaaaaatataaaaaaaattagttaggtatggtggtgggtatttgtagttatagttatttgggaggttaaggtaggggaatcgtttgaattcgggaggtggaggttgtagtgagtcgagatcgtattattgtattttagttttggtgatagagcgagattttatttataaaataataataataataataataataataataataataaaattttaaaaatttaaagattgggttaggcgtggtggtttatgtttgtaattttagtattttgggaggtagaggtagatagattatttgagattagaagttcgagattagtttggttaatatggtgaaattgtttttattgaaaatataaaaattagtcgggtatggtggtaagtgtttgtagttttagttatttaggaggttgaggtaggagatttatttgaattcgggaggtagaggttgtagtagtggagatcgtattattgtgttttagtttgggcgataaattgagattgttttaaaaattaaaaaaataaatatttaaaagttggtttaatattgatttttaata

SEQ ID NO: 163 - DNA, 6030 bp, Artificial Sequence
  chemically treated genomic DNA (Homo sapiens)
  unsure (576)
ttatttttgttttttttagaatttttgtttttttttttttttatagatttttcgttacgtagttcgtgtaggttttttttatttttgtgaagttttaaatttaattttgtgggttttattaagttgtgataaagtatgtataggggttttggtagaagataacgttaatataggtagattggagttgggtttatgttgaaaaaaatttggattattaatttaagtggtttgttattgatttttagattagagatgtttaatagaattttttttagtgatggaaatgttttatatttatagtgtttaatatagtagttgttagttatatgtagttttatagagtatttgatatgtggttagtatgattgagaaattaaattttaaatttaattttatgtatttatttatttttataagatagagttttatttagtcgtttaggttggagtgtagtggtgtaatttcggtttattgtaatttttgttttttgggtttaagtgatttttttgttttaggtttttaagtagttgggattataggggtttgttattatgtttagttaattttttgtgtttntatagagagggggtttattatgttggttaggtttagttttgaatttttgatttaggtgatttattcgttatagttttttaaagtgttggaattataagtataagttattgcgtttggttgattttatttaattttaattattttaaatttaaatggttatatatggttaaggttattattttggatggtatagttttagatattagaagttatattttttattttgttttgtttttaaattgggagaatgatatatgttagaaaaaaaatggaaataatgtgggtatttgggtggtgaggatgaggtaagaagaaaattattttttgtttttgatattaatgtttttaataaggatgaggaatttaggaggatgagtgggtttgggaaggtagataggaagtttaatattgagttgagattatgggatatataaatagagatgtttaataggtatttaaagaagagtttatagtagaatagaaaaagttagggttagaagtataaatttttgtagttatttttgtagaggtgataaagttatagaatataggttatattttttagagtgggagtgtagattttgaagaaaagagtattgagtatagaatttagaaaaatgtgtatattgaaagagtcgagttaagcgtagtagtttatattcgtaattttagtattttggagggaggtaggaggattatttgagtttaggagtttagtttgggtaatatagtaaaattttgtttttataaaaaatataaaaattagttaggtatggtggtgtatatttgtggttttggttgtttgggaggttgaagtgggagggattatttgagtttaggagattgaggttatagtgagttgtgattatattattgtatattaattttagtttgtatgaaagaataaaatttttttttttttaaaaaaaaaagagagagagagagaaagaaaaaaagtggaaagaggaagagtagtaggtaaataggaaatatgaaatatttattatgtaatgtttttaagaaattggtatttaattatgtaagtgatagtagaaagtttttgttttaggtgtagtgtttgttaggaagatttaatattttatttgaaaatgtaagtataggtataatgtaattaatttttattgttttattatatagatttgatagatagtttttatttggttaatgtttgttattattatattattatagtgttatttttgtttatagaattataaatgtgtttgttaaatgggtttaatatttgggtagattgttaataaatgttataaattttagtttaaataaattagtttataaatttaggagaatgtttagttatttttggtgttttttagataattagtagttgtaattaatgatgtttaaatggattttttatataagattaaggagaaattgtttgatataatttatataatttgtatttttattatttgagtgggaagttttattattttttttatattgtgttatatatttgtagaagaatataaaaggtagtgattatgttacgtgttaagaaagatattagagtagattgaaggggtgtagtatgagtaaagaatttgagattagagaaaaggttttggaaaggaaggtaagtatggagaaggaaatttgaaggaatagattggttgaaggttagatttgtggagtagatagtaggtaataggttaatttgttgtttagtttagtgtttgatatataataggtgtttagtatttattgaaggaaggaatgggaaaaggaaaatttattttgtaagaatagtagaattttattttggttttattttattttatttgttatttgattttagttattatatttttttgattttgggttgttgttaggtttattgttaaaatatatattaaatagtttatattttaatttgtaattgttgtttagttttggataattggagggtcgggggggtgtttttttatttagagaatacgggaatacgtcgggcgcggtggtttacgtttgtaattttagtattttgggaggtcgaggcgggcggattacgaggttaggagatcgagattatttcggttaaaacggtgaaattttgtttttattaaaaatataaaaaattagtcgggcgtagtggcgggcgtttgtagttttagttatttgggaggttgaggtaggagaatggcgtgaattcgggaggcggagtttgtagtgagtcgagatcgcgttattgtattttagtttgggcgatagagcgagatttcgttttaaaaaaaaaaaaaaaaaaagagaatacgggaatatatttgagtatttggatgtttaatttttttttgttttaagattataatagagtaggtgtgattatatttagtttttgaatattttggttttgggtgatataggtgagtatttttagttgatttgataggttaaaggtgtatatttattttttttgtaagaagcgttatttggtaagatgattaagaatggtgtaaagtaggatggggagtttaaaattgtttttaaatgtgggaatgtaaatgaatataaatatgtaagattttaatatattaaattgattagattttgtgtaatttttaagtttttttttttttttaaaatttttttgaaatttgattgtttataaaaatttattttatagaattttatgtgatttatttatttagatattatattgattttatatttagtagtgaaaatagattttattgtagaatttggaaagatagagggttatataggttgtatttttagttttgtttatattaatacgtgtttataatttagtttaatttatattttgtattgtattattgttgttatatttttgtatgtatgtaagtataatatgtgttggtaaaggaaaattttgagtaagaagaagttttttgatttatttgatttaatatgtatttgagtgtttaatagatattgttttagatattggtgatataatattgaacggagtattaaatattttatagcgttttttggagttgttgttaagatatattttttaaggggaatattttagaataggtgataattagttaacgaaggaaaagtattttagttatttaggagagttgtatttagagtgaattgaaataaattaagtttacgaaagatagagattttttgtttggtttttgtttgttgtatttattattgtatttttagggtttaaaatagtgttcggtttataataagtatttagtaaatatatgttgttgattggagtgtttgttttgaatttttgtaattaaatatatattttggtaaattatttttatattttgttagttgaaaattttattttagttgttttgtttttaatgttattttgttttttgtttttatttgtgttatatattaggatgttggaaaagtttattaatattgatagttatatggttatttgatattgaaaagaatagatttggaaaggaatttaagaggttattttttgtttagttttttgtttaggaaaattaagtaagatgattaggtatgtatatttaattagttatttaaaaaaaaattaggataatataattgagtttttttttgagaaaatggagaaaggtatttaattttagttataaagggattaatttggaaattttagaatttttgtgtgggaaagtggaaaaaaaaaaaaagtataattaagttgttttttgttgatattagaaatgggtttgttatttattttggtattgaagtatagttttttatttcggggtaggattgggatatttttttttttttataagagttggatagttattataggtttaaaaagtttcgattagttttttaagagttttttttttttttttttttttgaaattcgtggtgtttttgttttgtttttaagatgtattaagttttttgttttgtgattgttttggagttagtagatattttgatatgtataatttaaattatgtaggttttacgagtaagtttaattttattttttaagttagttaaaaggtaagtgatatttagaaaaatgttaatttgtagttattttattttttttattttaagtatttttattgtttttcggttttttggttaagattaagtgtgtattttaagtattttttaaaataaaaatatttttttaatttaataagaaaataaggttttatatagaaaagtttttttatttaagatttgtattttttaattttttttgagatgtttttgttgtaaatagtatttatatgttttttgaaagttagttaattaaatagtttttttgagtatttttttagttttattgagaagtattttaaattgagtttttttgagttcgattgtttacgtttgatatagttttaagtttttattgaatggtaataaagattgtagaatgttgttggtattgtagtgagaggtatgtttttttagattaggtaagagagattagtttgttttttattgttgggtgagtttttatagtttttattttatattttttaagtagtagtaatattaaattgataaatagttaggagtacgttgattttaagacgtttttgtttgttgtagatagaaaaattatagggttatgtatgggggttggggtggggggggaggggaagaattagtttattatttagttatttatataaattaattaaaatgtgaaaataattttggagtttagtttttttaatttaggaattaaagtagtagttgaggaaattagtaattttaaaggtattttatggttattatttgtgaaagtaatttaaaggatagtttttatttttatttttttttttagtagttaataaaataagttttgtttttaattaaatattttttttatttacgaaaatttttaaattgttaatagtaaaatatattttttaaggatttttggaaattaatttgatatttgaaaaatattttagtttttatagttgttttatttttttttttttttagtatattttttttaaaagtatttgtgttttgaaaatgttagttgtattttaatgaagtttaggtattgtttgtttataaaggggtcggtgtattttattgttttatggtttattatgaggtatagtgtgagagtgtgggtggtattatttggtgtttgttttttggggtagtgattgttattatgttagttttggattggtaaagaaaatatagtatataagatgttatatgaatttggatattgtgaagaaaattttatttttaaataatttttaatgatttcggaatatatgataatttgattgaattgattattttaattatatttttgaagtttgtattttagttataacgtatattttattagatacgttttattttttgatatataatagtatttagttattttttgaagtttaataaggaagtgaatgtttttaaattatgatgtttttaatagat

SEQ ID NO: 164 - DNA, 6030 bp, Artificial Sequence
  chemically treated genomic DNA (Homo sapiens)
  unsure (5455)
atttattaaaaatattatagtttagaaatatttatttttttattgaattttaaagaatgattaaatgttattatatattaaaaaataagacgtgtttaatagaatatacgttgtaattaaaatgtaaattttaagggtataattgaaatgattaatttaattaagttgttatatatttcggggttattaagaattgtttaggggtaagattttttttatagtatttagatttatatagtattttgtatgttatattttttttgttagtttaaggttaatataatggtagttattattttaagaggtagatattaaatggtgttatttatatttttatattgtgttttataataaattataaagtagtggaatgtatcggtttttttatgagtaaataatgtttaagttttattagaatatagttgatatttttaaagtataaatatttttaagaaaaatgtattagggaaaaaaaggaatgaaatagttataaaagttgaaatattttttaagtgttaggttgatttttaaggatttttgggaagtatattttgttgttggtaatttaaaagttttcgtaagtggaaaaaatgtttagttaagggtaaagtttattttattaattattggggaaaaaaatgaaagtaaaaattattttttgaattgtttttataagtaataattatgaagtatttttaaaattattgatttttttaattgttgttttagtttttgaattaagaaaattgagttttagaattatttttatattttaattaatttatataagtaattgagtaataaattaattttttttttttttttttattttaatttttatatataattttgtagtttttttgtttgtaataagtaaggacgttttgaaattagcgtgtttttggttatttattaatttaatattgttgttgtttaaagaatataaaataagagttgtaaaaatttatttagtagtgagaaataaattgattttttttatttggtttaaggaagtatgttttttattgtagtattaataatattttatagtttttgttattatttagtggaaatttgagattgtgttagacgtaagtaatcgagtttagaaaagtttaatttaaaatattttttagtaaaattaaaaagatgtttaagaaaattgtttagttaattggtttttaaaagatatatgaatattgtttataataaagatattttaaaagaaattgaaaagtgtaggttttagatgaaggggtttttttatgtagaattttgtttttttattaaattaaaaggatatttttattttaaaaaatgtttaaagtatatatttgattttagttaaaaggtcgagaagtaataaaaatgtttaaagtaaaaagggtgaaataattataagttaatatttttttaaatattatttgttttttaattaatttaaaaaataagattaaatttattcgtgaaatttgtataatttgaattatatatattagagtatttgttggttttaaagtagttataaagtaggagatttaatgtattttgaaagtagagtaaaagtattacgagttttagggggaaaagaggaggagaaatttttgaaaaattggtcggggttttttgaatttgtaataattgtttagtttttgtgggaggaaaaaaatgttttagttttgtttcgagataggaggttatgttttaatgttaaaatgaatgataggtttatttttgatattaataaagagtagtttagttgtgttttttttttttttttatttttttatatagaagttttaaaatttttaggttagtttttttatagttagggttaagtatttttttttatttttttaagagggaatttaattatgttgttttggtttttttttaaatgattaattaaatatatatatttaattattttatttagtttttttaggtaggaagttgaataaaagatgattttttaggtttttttttaaatttattttttttaatattagataattatatgattgttaatattaataagtttttttagtattttgatgtatggtataagtagaaataaaaagtaaggtaatattaaaaataaagtaattgagataaaatttttaattagtaagatgtaaagataatttattaaggtatgtgtttgattatagaaatttaaaataaatattttaattaataatatatatttgttgaatatttattatgagtcgagtattattttgggttttggagatatagtagtgaatgtaatagataaaagttaaataaaaaatttttgtttttcgtgagtttagtttattttagtttattttaagtataatttttttagatgattaaggtatttttttttcgttgattagttattatttattttgaaatattttttttggaaagtatgttttgataatagttttaggagacgttgtaaagtatttggtgtttcgtttagtgttgtattattagtgtttaaaatagtgtttgttagatatttaaatatatattgaattaaatagattagagagtttttttttatttaaaatttttttttgttaatatatattatatttatatgtatatagagatatgataataataatataatatagggtgtaaattaaattgggttgtaaatacgtgttagtataaataaaattgaaaatataatttatatggttttttatttttttagattttataataaaatttgtttttattattggatgtgaggttagtataatatttgagtaaataaattatataaaattttataaagtaagtttttgtggatagttagattttagaggagttttgaaagaaaaaagaaatttggaaattatatagaatttgattagtttggtatattaaaattttatatgtttatatttatttatatttttatatttggaaataattttaaattttttattttgttttgtattatttttgattattttattagatgacgttttttatagagaaaataagtgtatatttttaatttgttagattagttagaagtgtttatttgtgttatttaaggttagaatatttaggggttagatatggttatatttattttgttatagttttaaaataaaaggaaattaaatatttaagtatttaagtatattttcgtgttttttttttttttttttttttttgagacggagtttcgttttgtcgtttaggttggagtgtagtggcgcgatttcggtttattgtaagtttcgtttttcgggtttacgttatttttttgttttagttttttaagtagttgggattataggcgttcgttattacgttcggttaattttttgtatttttagtagagatagggttttatcgttttagtcgggatggtttcgattttttgatttcgtgattcgttcgtttcggttttttaaagtgttgggattataggcgtgagttatcgcgttcggcgtattttcgtgttttttaaataggagagtattttttcggttttttaattgtttagagttagataataattataagttaaaatataaattatttagtgtatgttttaataataaatttaatagtaatttaaggttagaaagatgtgataattgaggttaagtgataaataaaataaggtggggttaaagtaggattttattgtttttgtagaatgaatttttttttttttatttttttttttaataaatattgagtatttattatgtattaggtattgagttgggtaataaattgatttgttatttattgtttattttatagatttgatttttagttaatttatttttttaagtttttttttttatgtttgtttttttttttagagttttttttttggttttaaattttttatttatattatatttttttaatttgttttgatgttttttttggtacgtagtataattattattttttatgtttttttgtaagtgtatgatatagtgtggggaaagtaataagattttttatttagatgataaaaatgtagattatataggttgtgttaaataatttttttttaattttatgtagaaaatttatttaaatattattaattataattattgattatttggaaaatattaaaggtagttggatatttttttaggtttataaattgatttatttggattggagtttgtgatatttattggtaatttgtttaaatattaagtttatttaatagatatatttatgattttataggtagaaataatattataatagtgtaatgatggtaggtattggttaaataaaaattatttattagatttatataatgaagtagtagaaattagttatattgtatttgtatttatatttttaagtaaaatattgaatttttttgataagtattatatttaaagtaaaaattttttgttattatttgtatggttaggtgttaattttttaaaaatattgtatagtaaatattttatattttttgtttgtttgttgttttttttttttttatttttttttttttttttttttttttttttttttttaagagagagagggttttgtttttttatgtaggttggagttgatgtgtagtggtgtgattatagtttattgtagttttaattttttgggtttaggtgattttttttattttagttttttaagtagttaggattataggtgtgtattattatgtttggttaatttttgtattttttatagagatagggttttgttatgttgtttaggttgaatttttaggtttaagtgatttttttgtttttttttaaagtgttgggattacgagtgtgagttattacgtttagttcgatttttttaatatgtatatttttttgagttttgtgtttaatgtttttttttttaagatttatatttttattttagaggatgtgatttatattttatagttttattatttttataaagatgattatagaaatttatatttttagttttggttttttttgttttgttgtaaatttttttttagatgtttattggatatttttgtttatatattttataattttaatttagtattgaattttttgtttatttttttaaatttatttatttttttaggttttttatttttgttaaaggtattaatattaagaatagaaagtgattttttttttgttttatttttattatttaaatgtttatattgtttttattttttttttaatatatattatttttttagtttaaaaataaaataaaatgagaaatataatttttgatgtttagagttatattatttaaaatggtagttttagttatatgtggttatttaaatttaaggtgattaaaattaaataaaattagttaggcgtagtggtttatgtttgtaattttagtattttgagaggttgtggcgggtggattatttgagttaggagtttaagattgggtttggttaatatggtaaattttttttttatanaaatataaaaaattagttgggtatggtggtaggtttttgtaattttagttatttgggagtttgaggtaggagaattatttgaatttaggaggtagaggttgtagtgagtcgagattatattattgtattttagtttgggcgattgagtgagattttgttttataaaaatagataaatatataaaattaaatttaaaatttgattttttagttatgttagttatatgttaagtgttttatggagttgtatgtggttaatagttattgtattgaatattgtagatatagaatatttttattattgaagaaagttttattaaatatttttgatttagaaattaatggtaaattatttaaattagtaatttaaattttttttaatatagatttagttttaatttatttgtgttaacgttattttttattaaaatttttatgtatgttttattataatttagtggggtttatagaattaagtttaaggttttataaagataagggaggtttatacgagttacgtggcgagggatttataggagggaaagaaagtaaagattttagagaggatagaaatag

SEQ ID NO: 165 - DNA, 13606 bp, Artificial Sequence
  chemically treated genomic DNA (Homo sapiens)
  unsure (4649, 7634, 7657)
gagttcgagattagtttggttaatatggtgaaattttatttttataaaaaataaaaaaaaattagttaggtatggtagtgggcgtttgtaattttagttatttgggaggttgaggtatgagaatcgtttgaattcgggaggcggaggttgtagtgagtcgagattatgtaattgtattttagtttgggtaatagagcgaggttttgttttaaaaaaaaaaaaaaaatggaattaattaagtttttatggtaaatagtggggggaggggttggggttttttaagatagtggtttttaagataagtatagggatttggggttatttgggaatatgttagaaatgtaaatttttaggttttattttaggtggattgaattagaagttttgggagtaaaatttagtaatttgagttttaataaggtttttgggattttgggaagtttgagatttattgttttaggttttcggtttttaataattagttttttaggagaatttagtttaagatttggggatatgttagttgggcgtggtggtttatttttgtaattttagtattttgggaggttgaggtaggcggattatttgaggttacgtattggatattagtttggttaatatggtgaaatttcgtttttataaaaaaatataaaaattagtcgggtgtggtgtgtgtttgtaattttagttgtttaggaggttgaggtaggagaattttttgaattgggaggtggaggttattatgagttaagattatatattgtattttagtttgggcgatagagtgagattttgttttaaaaaaaaaaaaaaaaaaaaagatttgggggtatgtttattttttttttttgtgttgttttattttaaagtttagttatagggcgtaattagatttagtttgatttagagtaaaaagtatttattgagtgttttttgtgtgtagattttggaaatgcgggtaaatggtataatagtagtaggttaatgagtagttgagattttaaagaggagtggaaggtattgggtgaggggagagtgaaagaaagaaaaggttagaattttatttgtttattttttttttattttatttatttttttttttgtttcgaggtttttattagaataaatgattgtggtttaaattgttttgaggttggaggtagaaattaagtttttatttatttttgttggttatggggattttaagttagttaatagttataggtttttgattttttatgagtaattaaaagaagatgaggattatgtatataggtatatataaatattttttgcgattttagatgttagggtagggagattaagagaaggaatgaagttttagaaggttggaagttttttgggtaaaatgagtttagtagataataagtaggaaaagttttttaataggggagggcggggttatttttggtttattttatttttttgagatttagaaattgtggttagaggaaataaagggtttttaaggtaaattataaaagtttttgagaatgaaatttgagtttggaaagagagtagagaatgagggatggatattagatttaaagggtttttttatataggtaaatgggggttagggggttgggagggatgtgagttatgtttagtttttttttttgggttttttttttattataggtagtttttaggagtagaatttttgttattgttttagtttgagtagttgatttttggtttttttttgttttattttttgaggaataagtttttttttgatttttatagagtttttttttttgtttttttgtaaggttttttttttgtgtttgaaaggttttgggtttaaggagtagatagttttgtaggtttaattgtagtgatttatattggtttttttttaggttttgggtgcgggggttgagattttaagataggaatttgggaatttggtataggtttatagatgatgatattaggtagataggttgtaaaagtggtattgagggattggattttgaggtaggggatgttataggattatgtttttattttgttatttgagggttttttatggataagagattagaagagattaaatgtaaaaatatttgagtagtgattttttggagaggagttagtggtttttgataggtttagtttttattaatgagatttgggagtggtttttgtttgttttttgtttttgttgaatttatattggtttgttgtaggggattggaaagatgatgtggaagaatgagttcggattttagttgatttattttagggaaacgaaggttgggtaaaagttagatatgtagaaatttacgtatttttaggtttaattataatatagagattttgtatttttttagatttaatggttttgagaaggatttagaaggagtttttaagattaattattatttataaagtttttattttaggattttggtaattgaatttttttttttagttattagttttttggaatagagaaggtagtttttgaaataggtgtttttttttttttttattataagttatagtgtttaggatgattattgtttttagattgtgtgatttgttttggtaaggaaattttattgtggggggaggaaatgaggtagtcgtgatataaagtgatggatgagttttttgtttagtagagagagagagaaagtcggtaggttgtgtagaattgagtggtttttgggtttaaagggtttttttttggttaagttttattttaaagtttaggaagtttatagtttggcgttatggaagagagataaaatcgtagtatttttttttttttttttttggatattattatttttgttttgatttagattatcgttggttttttttattgttttttagttttgtttttgtgatgtagagtataaatgtattttatgtattgggatttttttttagttttttgagtagtttaattttaagggattagttttatatagggtagagtatagattttgagtattatatattgtagttttgttttttagggtttcggttaaatttgattatcgaggaggtggtatcgattggtagatagttatttttagtgtattttattttatttattgtattgattttgtatattgtagttttttgttttatattgtagttgttgtttgttttttgtgagtttagattgaatataggttcgtttattgtatggaggtttcgtacgttgtagttttaattttttattatagttgttattgtatattataggttttttttatttatggtatgtttttaatattattattgtattttgtacgttataggttttattttagttgttttttttatttttatggttttagggattttaagagaggtattttttttttcgttaagtattacgaattttagtattttttgtgaaagaagtggttttaatagtattgaggatgtaggtggttgagattaagatatgagtaagggtagtttaatttgggtaagttgtggtttagaattttatattcgttaagtgattttgtttagtataaattgggcgattagtcgagtagttttttttaatatatatatatttatatatatatatatttatatatatatttttttttaagagtagattatgtagttagggttttattttgagagtcgtgggaaggttgtggttttcgttggtaaaattgggttaatgatagtaggggaatcggcggggttaggggggtgttggggtaattagggttcggtttggcgttaggagattttgagatgaaaggtgttttggcgttattgggttggttttatgtttatgaatgtaggtgtgtggtgtgtgtatgtgtgtgttgggggtggggttggtatggtggagattttttttttgggttgggttagggggtttatttgtatgtagtttatcgttttttttagattgattttggtattatttggatttttgtgggagtaaatatggggggaaatattattattcgggagttaggaattgagggggtatggtagattttgtttttttttcgagtttaggagagggagtagattgttgggggaaatggttggtgatagagaatagaaagagtttatatggagaagggtgacgttggaaaagggaggtagtggatcggtattgatgttagaaatgagaggggagggaggtaatagggaatgaatttttataaggatgaaaaacgtaagatgattgaagttaaaaggatattaggggttatttgtttagttttcgtagttgaagtttgaggaagttttgttttcgatagtagtggcgatttgttaaggttatatagtgagttatcggcggagaagggattcgaatttttaaataaattatatttgtaagcgtttggtgtttagatttttttttcgatgtataaggtataggttgttcgtcgatatttttttttttatttttacggtgtatattcgaaaattttttaattttttcggtaagtaaaggttattttttaatgatattttttttaaaatatgttattaagtatttatttttgcgggagtcgttcgggttggggagggcgagttcgagcggggcggggtagaggcggtcgaggggcggtcgggtttttggcgggggtttcggggcgcggtagggggcggggggcgggggcggncggcggcgaggcggtttgtagggagtagtcgcgagtcggtcgggcgcgtcgagttcgagttttagtcggagcggggcgggggagggaggagttagagcggtcgtcgtttttgtcggaggagtcgcggggtcgttatattcgtttttcgtttttttcgggtttattggtatttatattcgggcgtaggaggcgggcggttcgggttttatcggttttttatggacgtttttagtacggggcgttgagattttcgcgtcgttgtttatttcggttcggcgcgttacgtcgaggtaaggaggagggagcgagggggtattaatatgtaaatgttttgcgattgattatgtaaagtcgcggggtttcgtggttagtttttaggcgggttaggggcgtttagggggtgtttgttgttagttttagttttttttggcgttttagtgattttgttacgagttcgggagtttgtaattgacgttttggggaagggaggtgttgttaggaggtcgttgggtttcggggttcgtaggcggagatggcgttcgagtttttttttggagggttcgttcggtttttgttcggttagtttgttgcgtattttcgggtcgggtttcgttgtcggtcgtcggagttttttcgttcgtcgcgtcgcggtttgtttacggtgcgtcggaggtttgtttttttagtttttatttttagtttatgaggttcgagtggtttttgtaaagttgtttttagttgcggagggtagtatgagtgcggtggcgcgggtgggtttgtacgggttcggggagagggaagttttttcgttttattcgtttttcggttgagtatggttgtttggttgtaatattgttaattgtaaaaacgcggttgttgggggggaatgtgtgtgtggaaggggtgtatttggtggtgtttagatgattaggagagttgttggttggggaggagagggagaaatggatttgtgtgtgtgtattttattttgtttttttttttttgtaacgtgtttttggtgttttttttttatttggggtttttttttgtttagcgtgaaagaaaggtttggggggatgataggggtaattgaaagaattatcgttttaggggtgggggtgggggatatagaaggaaagttagtgaggtgggagtttgttttttagtgttggttttggttttaggagggggaggggatgaagggggttgttgtttaaaatgaggggggaagtaaaagtgatacgtagatatagagatatgtttatatagatagttatatgtatatttagggatatttaggtagatttaaggataggagttattggatatatttatatggggataagggaagagataggttgttgttgtatcgtggagttttgaggggtgggatatatttatgggagattaagagtatggggatcgatttatgtatatatttacgtatagggttatacgtagatgttgttatatattggggtaaggaggagttgttgttatttatatataaaaagttattgttatatgtatgtatgtatatagagtaattgtatatagtagtataattataaaagattttgttatttataggtatatacgtgttcgtatgagtttagttatatagatattattgtttgtcgtgatagtcgttgttatttagttagatgtaaatatagttatatattaatatatgtatatataatttagtaataagtatttttttggattttttattgtggagttttgaggttttgtaggtaataaaatttttgtttttaagaatattaaatttggttgtatgaaaaagtgtttttgcgtaatggtgtaaagtatgtatttttaatgatacgtttttggtttttatcgtttgagatattattttattagatagtgagtttttggagatttgggagaattatttaaagagttttggattttacgtagagtttagtataagggttgttttgtaaatatttgttagttgattgattgtggaatttgtagatataggtgtatttatttgtatatggttttttgaatttaggtgtagaacgagtttataaggtttaggtttttatagttgtaggtttatattaatagtcgtgtttatataattttagatgtatataattgtagtttgtgtagtcgagtatatatttagatgtatataattataaattttttttttttagtttttttttttttttttttttttaggtttagttattgtgcgggaatgggttgtttttttttttttttttttttttttagagggatagagaaataagagtaaagatagtgggtttaggggggttttagagggtcgagttatgggtttaaagtagtgtttagtgatttttagaagttaggatttttttgattgttggggaaggggagagttgtttttttttttattttaaaagtttaggggtgtttaattgtttttgttttgagttatttgtttgggttttttttgggaatagttagttatttttagttgagtttttgcgttttattttgagtttggtttttttttttatttgtatttttttgtttaaatttggaagttttttttaagaggttatcggttggcgagtgtttgtgtgagtgatatgtatttttgatttggaatttttttttaattttgtttttttgttgttttgttttgtagtgtttgattttttttttttttttttttgtttttttgttagtttgtaatttttttttattttgttgttattttcgatttatttttgtttttgttttagagttggggattggtagtaatgttttttatatttttttagttgttaatatttaagtttcgtttttttgttttttttgcgtagtttttggggttagtttgaggttggggtggggggcggggggtttagttggttgtttaggattttttgtatttttttagtgtcgtagttgtggttagtaagttttaggggttgggaatgggggaggggggggggttanttattgtttatgttgattttttnggtttgtatgtttggagatattagttttgtgggtatttttagggtgtaggttgtagttagttagtagtttttaaataagttatgaagaggttttttttatattggtttaagttggaaaagaatcgtttttatgggtagtggcgggagttggtaggattttgttgagttgggtttattgtagggtttataatggtttttttttatatttttggtagttgaggtttattttagagatgtttaatagttgtgttttttttgtttagttttagggtttggttttgagggtatagttgtttagattaagtatgtattaagcgaggtttttttattcgtgagtgtaggttttagtttagaaggggtattttttttggagagggaatttgaggagggggaatttaggtaggagatatcgagttcgggggtattaagtatttttcgttatgtttttttttagttttggattatttggaggtggaggtatttggtagagaatttatagggtagttatagaggggaaagattgaggtttggttttagggaatatatagttggatgaaagaataaggtattgggtcgggtatagtggtttatattcgtaattttagtatattgggaggcggaggtaggtagattatttgaggttaggagtttaagattagtttgattaagatggtgaaattttatttttattaaaaatataaaatttagttgggtgtggtggcggggttttgtaattttagttatttaggaggttgaggtaggagaatcgtttgaatttaggaggtggagattgtagtgagttgagattgtattattgtattatagtttgggtgatagagcgagatttcgttttaaaaaaaaaaaaaaaaagaataaggtattatttattaagtaggtgatatattattatagttgagaatagagatgatggtgatgattatgacggttatgattgatttggattgtttaggtttgaattttagttttgttatttgttggatgtgtgattttgagtaagcgatttaattttttcgttgttttatttgtaaattggggatgattatatttattttatttagtttttttgaggaaaaatgtttttaaaagtgtttagtttataataaattgtatatgtgagcggttgtgatgggtgaaggaagttgtgggtttggggttttttagattttttagagaagtttcgtggagaattgggttttttagatattagtgagattggggtttggggtagtgggtttttaatttttagtttttttatcgttatgtaattttttttttttagacgaatttttgtagcgtggaattagtgtatggtatttaaagatttaaggtaggtttttttgttttatttttttttgattttcgttttttagtttataaggagtttttggttttttagtttgggatatattttattagttaggggtatttgtataaatttttgggtattattgtatttttgtttagggtttgagttttgggggtgggagagagagaataaggaaagtcgtttttttttttatgtgtgggtttaaagaggaggtagtgtttttttttttttttgggagtttagtattggttaattaggatttagttttggttgataggtattagatttttttgttttttatggagtggtatttagtgtgaaaggtggtggtagagagaaattgaagtattgagtaatgattagtgtggtgggtatagtattttgagatttagtatttgttttgggttgtttttttgtttttgtgagtttggtgattaggattttttttttaaattttttttatttagttttgttttttaaggtgaaggaaggataatgggaggatattttgtaggggtgacgggaagtttttggagtgggaattaattttaattttagttttcggttgggtatagtggtttatgtttgtaattttaatattttgggaggttaaggcgggaggattatttgaggttagtagtttatgattagtttggttaatatagtgagattttatttttaaaaataattttaaaaagttagttaggtgtggtggcgtatgtttgtgttattagttatttgggaggttgaggtcggaggatcgtttaagtttggaaggtcgaggttgcggtgagttgtgattgtgttattgtattttagtttgaataatagagtgagattttttatatatatatttttttaaaatagatagaaaataaaataaaaattttaattttagtttttatggttgtaaaggtgtttaggggattttggagaattgttgtgttttttggggagggaggtaagtatgatcgtggtgggaagattattggttgggagttgggacgtttggttgttgatatttattagtcgtatgattttgggtttgggtttttattatttagagataatggtttttgttttatttaggttgagggtaaataatataaggtgggatgatttttgtgtttaatttatgttgtattttggtatggtgagtaatgtttgtggatttttttttttttttagggtttggtatatgttagggtggggtatatatatgttgtttggaattagagatagtttttagttttttattgaagtatttggggttggtgtgtggtgggggtatatgtggttttattttggtgttatttggtaggttaaagttggggttatagggatttttttttcggtatgttattgcgtgaggtggtttagagggagggttagaagtttgttgggtagataagggaagtaagatgggtgttattggtgtttaggaaatattatttttgtttcgttgttttgggggtgggtattaaaggttgatattaaagttttagttatgttttttagtagtggttaagagtagaatgattggattaagtttttggtttattttttttttttttttttttttttttttaaagaagatatcggtttttggtttttagagttttagttgtttgttttttttttttttttattaggtatgggggtggggaaataggggaatcgaggttttggtgtttttcggtatttttgtatatattagtgagtgggtgtgttgtgtacgtatttatgtgagagtgtttttgtgtatgtgtgggttggggagggttttgaatattttttggaacggtatttagagttttgtggttttgcgtatgcggggtgagtgtgtgtgtttgtacgtgttcgtgtgtgtgtcggagatttagttgtatttacgcgcgcgttttttttttttttttttttttttttttttttttttttttttttttttttttttttttttttttttttttttttttttttttttttttttttttttttttttttttttttttttttttatttttatatatataattttaatttttttttttttttttttttttttttttttttttttatttttttttttttttttttttgtttttgtttttttgtttttgtttttgtttttttttttttgtttttgttagttttgtttggttaggggttagttttagtttttggggtgtttgggagaatatttttttttttttttttttttttattattttttttttttttaggttatgttttttagggtttgtaggtaattttttttattgttttagatgagggagtgaggagggaggattttaagttttgtgtttatggtgttatttgtagtaagtgttttggtttcgtgatatttatgtttttagtatttagttgttttagtttttagttttaattattcgttggttgttgggggagggtggggagaatgtgtcgtgtttagtttgggggtgtttttgtttttgtttttttggttatttggattttttgtttttatttttgaggggaattgggtagggggggcgtgaagttttgtgggttgataaggaggggttgagttttttagtatgggtgtgggtatgattatttattagtggttatgggggatggatgtgatttgggaggagatttttagatttgggtatttattttgatgtttggttggagttggttcgggtaggaggagggagaggagagtagtaggtgggtgaggttatgggggagtcgagtgggaagtagtttttgatgttaatattgggtatttggtttaagttaaggttgttgtttatgtttttttgtttttgatttgtagggggggttttttgttatatttttttggggcggggtggggaggattttttgtttaagtaattaattttttttttatgaggatttttattttattttttattttttagtttttaaggttttatagtggttaggtgatgagttattgttttttagttttagaatttgttttttgggggtttagtgagagtttattaaggggtgtcgtttttttttttttcgttttttttatgtttgttaggttggggttttgagtttgtgtgtatttttttgttatattatatttgttaaatagtattttttttttcgtttttatttttttttttttttttggtattaggataatagagagttgggtggggtagttttgtttaatttatatttgagaatagaatagggggtatgggaaaggatagggagtttcggttttagagaggtttttgttttttagtatgggggtatatgtcgttgttgtagtattgttattattatagatttttaggggtttttggtgtgggtggttgtttgtggtgttcgtgttggtatgggggggtagtgttgtttatagacgtttgtgtttatgtatgtttatttatgtgtttgggttacggtgtttcgttttgttgttggttttgtttaattttttgatttatttttttttttttttttattttggttgtttattagtttttgggggtggggttagggggtttaggggtgaggttttttatgtagtagttacgtgatagaggttgaggtcgtatgttggggagttgtattttttgttttttttttattcgttatatttgtttgtgtgtatatagatagtaagttataggtttgtagtttagggttagaggtgtaatgtcgtaggaatggtgggttcggtttggtattgttttggattttaggtagtagaataaggttagtattagggttaggttgtgaggtttattttatagttatttgtttattagttgtgtgaatttgagtgaatgattaagttttttgagatttagtttttttatttgtgaagttttcgtgttttttttggagggtatagattttttttttagttaatatgtgttagttttttttttttttttttttgttattttggtcgatagtagtttagttaaattaattgagaagtttggttttttgtttgggaagtgggattcgagattttgcgtgggaagttttggagtttttgaggggttagagttggggattataatttggttggtagtatgggaggttagttttttatagtttttaatatttttttttattaaggtataaagatgggtatttatgtttattgcgtgtcgttttatgttttattttttttttatagatattttttttgtttatgttgaaaattgtttgtttttggtttttttttgtttttataatatagatgagttttaggaaagtttttttagaggggtggtaataatagttagtgtttaatagttgtttattaagggttaggtatttgtttgaatatgaagattgagatatattatttagtatatgaatgattttattttttttttttatttttttttatgtttggggtttaggaggtggatttttaatttcgtttgttgtatttgttatttaagggattattttggttttttttttatgtttgttttttttgttttttgttgttttgttatgggattttaaagttttaaatgttgttattaaagggattttatttatttttttatcgtgatatttttttatttttgttttttttttttttttatagg

SEQ ID NO: 166 - DNA, 13606 bp, Artificial Sequence
  chemically treated genomic DNA (Homo sapiens)
  unsure (5950, 5973, 8958)
tttgtggagagaagagagaggtaggggtaagaaggtgttacggtaggaaggtgggtaggatttttttggtggtaatatttggggttttgggattttataataagatagtagggggtaggaagggtaggtatagagaggggattaggatgattttttagataataggtatagtaggcgagattggagatttattttttaagttttagatatgggaaggaatggagggagagaatgagattatttatgtattaagtaatatgttttagtttttatatttagataaatgtttggtttttaatgagtaattattaaatattagttattgttattatttttttagaaaagtttttttgaaatttatttgtattataggggtaagaggggattagagataagtagtttttagtataggtagggagggtatttgtgaaggaaggatgggatatagagcggtacgtagtgagtatgaatgtttatttttgtgttttaatagagagagatgttgaaagttgtagggaattgattttttatgttgttagttaagttatgatttttaattttggttttttagggattttagagttttttacgtaaggtttcgaattttattttttaggtagaggattagattttttagttggtttagttgagttgttatcgattaggatggtaagggggaaaggaaaggaaattaatatatattaattggagagagaatttgtattttttaaagagggtacgagaattttatagatgaggaaattgagttttagaaagtttggttatttatttaagtttatataattagtaagtaggtggttgtgggataagttttatagtttggttttaatgttagttttgttttgttatttggagtttagggtagtgttaagtcgggtttattatttttacggtattgtatttttgattttgggttgtagatttgtggtttattgtttgtgtgtatataggtaggtgtggcgggtaggagggggataaagggtatagttttttaatatacgattttaatttttgttacgtggttgttgtataggagattttatttttaggttttttggttttatttttaggagttgataagtagttagggtgggaagagagagggagataagttaggggattgggtagggttagtagtagaacggggtatcgtggtttagatatataaatgggtatgtatgggtataggcgtttatgggtagtattgtttttttatgttaatacgggtattataggtagttatttatattaagggtttttgggagtttgtggtggtggtagtgttgtagtagcgatatgtgtttttatgttgaggggtagaggtttttttaggatcgggattttttgtttttttttatattttttgttttatttttaggtatggattgagtagggttgttttatttaattttttgttattttagtgttaggaaggagaggaggagtgaaggcgggaaggaaggtattatttggtaggtgtgatgtggtagaggagtatatatagatttagggttttagtttggtaggtatgggggagacgggaggaggggaggcggtattttttggtgagtttttattgggtttttaggagataggttttggagttggggggtagtgatttattatttagttattgtgggattttagaggttagagaatgggagatggggtggggatttttataagggggagattggttatttaaataaaggattttttttatttcgttttaaaagaatataataggaaattttttttgtaggttagagatagaaagatataaatagtagttttgatttgggttagatgtttagtattaatattaaagattgttttttattcggtttttttatagttttatttatttgttgtttttttttttttttttttgttcgggttagttttagttaggtattaaggtgggtgtttaggtttggaggtttttttttaggttatatttattttttatgattattggtgggtggttatgtttatatttatgttggagaatttagtttttttttattagtttatagaattttacgttttttttgtttaattttttttaggaatggaggtaggagatttaagtagttaagaaagtagaagtaggagtatttttaagttgggtacggtatattttttttatttttttttagtagttagcgggtaattggagttgggagttggggtagttgaatgttggaggtatgaatgttacggggttaaggtatttgttgtagatggtattatgggtataaggtttggggttttttttttttatttttttatttaaggtagtagaagaagttgtttgtaagttttgaagagtatggtttaggaggggagggaatggtggagggggaaagaaagggagggatgtttttttaggtattttagaggttggagttagtttttaattaagtagaattggtagaggtagagagagagagatagagatagagatagagagatagggatagaaagggaggagggagggaataggaaggagggaggaagggggagggaagagagaaagattgagattgtgtgtgtgagagtgagagagggagggagagaaggagggagagagagagagggggagggggagagagagagggagagggaagaggaagggagggagggagagagagagggagggagagagggagggagagagcgcgcgcgtgaatgtagttgagttttcggtatatatacggatacgtgtagatatatatatttatttcgtatgcgtagagttatagggttttgggtatcgttttaggagatatttagagttttttttagtttatatatgtataaaaatatttttatatggatgcgtgtataatatatttatttattgatgtgtataaaaatgtcgaaagatattaaagtttcggtttttttgtttttttatttttatgtttggtaaaagagaaaaagaaataggtagttggggttttgggagttaagagtcgatgttttttttagaagaggaaaagaggaggaggaggaggtgggttaggggtttggtttaattattttgtttttggttattgttgaggggtatggttgaggttttggtattaatttttaatgtttatttttaaaatagcgaagtaaggatagtattttttgggtattagtaatatttattttgttttttttgtttatttagtaaatttttgattttttttttggattattttacgtaatggtatatcggaggggaggtttttatgattttagttttggtttgttaagtgatattaaggtggaattatatgtgtttttattatatattagttttagatattttagtgagagattgagaattgtttttggttttaggtagtatgtgtatgttttattttggtatgtgttaggttttgggaaaaaaggagaatttataggtattgtttattatgttaggatgtaatatggattgaatataggggttattttattttgtgttatttgtttttaatttgagtgagataggaattattgtttttagataatgaaaatttaggtttaaagttatacgattagtgaatgttaatagttaggcgttttaatttttagttagtgatttttttattacggttatgtttgtttttttttttaagagatataatagttttttaaagttttttagatatttttgtagttatgagaattagagttggggtttttgttttgttttttgtttgttttgagaggatgtgtgtgtggggggttttattttgttgtttaggttagagtgtagtggtataattatagtttatcgtagtttcgattttttaggtttaagcgatttttcggttttagttttttaagtagttggtaatataggtatgcgttattatatttggttaattttttaaagttgtttttagagatggggttttattatgttgattaggttgattatgaattattggttttaagtgattttttcgttttggttttttaaaatattgagattataggtatgagttattgtgtttagtcgagaattagagttgagattggtttttattttaaaggtttttcgttatttttatagggtatttttttattgttttttttttattttgaggggtagggttaaataaaaggggtttggagaggggattttgattattagatttataaaggtaaagaggtaatttaggatagatgttggattttaaagtgttgtgtttattatattggttattatttagtgttttagtttttttttgttattattttttatattaagtattattttatggagggtaggggaatttggtgtttattagttagagttgggttttggttgattaatgttgggtttttaggagggaggaagggtattgttttttttttgagtttatatataagagaggggacggttttttttgtttttttttttttatttttagagtttagattttgaatagagatgtagtgatgtttaaagatttatgtaggtgtttttagttggtggggtgtgttttaggttgaggggttaagggttttttgtaagttgaagggcgagggttaaaggagggtggggtagaggggtttgttttgggtttttgggtgttatatattaattttacgttgtaaaaattcgtttgggaggaaaagattatatgacggtgagaaggttggaaattggagatttattgttttaggttttagttttattgatgtttaggagatttaattttttacgaagtttttttaagaaatttgggagattttaggtttatagttttttttatttattataatcgtttatatatatagtttgttatgaattaagtatttttaaaaatatttttttttaaaaaagttaaatgaggtagatatgattatttttaatttatagatgaggtaacggggaagttaaatcgtttgtttaaagttatatatttagtaagtgatagagttgggatttagatttaggtagtttaggttaattatggtcgttatgattattattattatttttgtttttagttgtgatggtatattatttgtttgatagataatgttttgttttttttttttttttttttgagacggagtttcgttttgttatttaggttgtagtgtagtggtataattttagtttattgtaatttttattttttgggtttaagcgatttttttgttttagttttttgagtagttgggattataggatttcgttattatatttagttaagttttgtatttttagtagagatggggttttattattttggttagattggttttgaatttttgattttaggtgatttgtttgttttcgttttttagtgtgttaggattacgggtgtgagttattgtgttcggtttaatgttttgtttttttatttagttatgtgttttttgagattaagttttagttttttttttttgtagttgttttgtgggttttttgttaagtgtttttatttttaaatagtttaaggttagaggggagtatagcgagaagtgtttggtgttttcgggttcgatgttttttgtttgagttttttttttttaaattttttttttagaagaggtattttttttaggttggaatttgtatttacgggtgggagggtttcgtttagtatatatttagtttaggtagttgtgtttttagaattaggttttgaggttgggtaaaaaggatatagttgttgggtatttttgaggtgggttttagttgttaggggtgtggagaaaggttattgtgagttttgtagtggatttaatttagtagggttttgttagttttcgttattgtttatgggggcggtttttttttagtttgggttagtgtggggggagtttttttatggtttgtttaagagttgttagttggttgtagtttgtattttgagggtgtttatagaattggtgtttttagatatgtaggttngaggggttagtatgggtagtggntgattttttttttttttttatttttagtttttaaaatttgttggttatagttgcggtattaaggaagtgtaggaagttttgagtagttagttgagtttttcgttttttattttaattttaagttgattttagaggttgcgtagggggggtagaggggcggagtttgggtattaataattggaaaagtatgaagaatattgttgttagtttttagttttgagataaggataggggtagatcgggggtagtaatagggtgagagagagttatagattggtagagaaataaggagagagagagggagaattagatattgtaagatagagtaatagagagatagagttagagagaaattttaagttaaaagtatatattatttatatagatattcgttagtcgatggttttttaaggaaagtttttaagtttggataggagggtataggtgggaaaaagggttagatttaaggtggggcgtaggaatttagttggaggtgattgattgtttttaggaaagatttaggtaaatgatttagagtaggggtagttagatatttttgagtttttagggtagggaggagagtagttttttttttttttaatagttaagagaattttagtttttagaagttattggatattgttttgagtttatgattcggttttttggaatttttttgaatttattgtttttgtttttgtttttttgtttttttaaaagaaagaaagaaaaaaaaaaaatagtttattttcgtatagtggttgagtttagaggaaaaaggggaggaggaagttgaaggggaaaaatttgtgattgtgtgtatttaagtgtgtgttcggttgtataggttgtagttgtgtgtatttggggttgtgtggatacgattgttggtgtggatttgtaattgtggggatttgggttttgtgaattcgttttgtatttgagtttaggggattatgtgtaaatgagtgtatttgtgtttgtaggttttatagttaattaattaataagtatttatagagtagtttttgtgttaggttttgcgtgggatttagagttttttaagtgatttttttaggtttttaagagtttattgtttagtagggtggtattttaagcgatagagattaagaacgtgttattgggaatgtatgttttatattattacgtaggaatatttttttatatagttaaatttaatatttttgggagtaagggttttgttgtttatagaattttagagttttatagtaaagagtttaggaaaatatttgttgttaagttgtgtatatatgtgttggtgtgtaattgtgtttgtatttgattgagtgatagcgattgttacggtaagtaatgatgtttgtgtgattgggtttatgcgagtacgtgtgtgtttgtgagtgatagggttttttgtaattgtgttgttgtgtgtaattgttttgtgtgtatgtatgtatgtgatagtgattttttatgtgtgggtgatagtaatttttttttgttttagtgtgtgatagtatttacgtgtgattttgtgcgtgggtatgtgtatggatcggtttttatgtttttggttttttatgggtatattttattttttagagttttacggtgtagtagtagtttgtttttttttttgtttttatgtgggtgtgtttagtagtttttgtttttgagtttgtttgggtgtttttggatgtgtatgtggttgtttgtgtggatatatttttgtgtttgcgtgttatttttgtttttttttttattttggataatagttttttttatttttttttttttttggagttaaagttagtattgaggggtaggtttttattttattggttttttttttgtgttttttatttttatttttggaacggtggtttttttaattgtttttgttatttttttaggttttttttttacgttggataagggagggttttagatggagaaggggtattagagatacgttgtaaggggagggaaataaggtggggtatatatatataggtttattttttttttttttttttagttagtaatttttttaattatttaggtattattaagtatattttttttatatatatatttttttttaataatcgcgtttttgtaattagtagtgttgtaattagatagttatgtttaatcgggaggcgggtgaggcgggggaattttttttttttcggattcgtgtaagtttattcgcgttatcgtatttatattgtttttcgtagttggaggtagttttgtaaaggttattcgggttttataggttaggggtgggggttgggggggtaggttttcggcgtatcgtaaataaatcgcggcgcggcgggcgggggagtttcggcggtcggtaacggggttcggttcgggaatgcgtagtagattggtcggatagaggtcgggcgggttttttagggggaggttcggacgttattttcgtttgcgaatttcggggtttagcgattttttagtaatattttttttttttagggcgttagttgtaagttttcgggttcgtgatagggttattggggcgttaggaaaggttgaggttggtagtaggtattttttgggcgtttttagttcgtttgggagttggttacggagtttcgcggttttgtataattaatcgtaaggtatttgtatattaatgttttttcgtttttttttttttatttcggcgtggcgcgtcggatcgggatgggtagcgacgcgggggttttagcgtttcgtgttgggggcgtttatggggggtcggtggggttcgggtcgttcgttttttgcgttcgggtgtgagtgttagtgagttcggggggggcggggggcgagtgtggcggtttcgcggttttttcggtagaggcggcggtcgttttggtttttttttttttcgtttcgtttcggttggggttcgggttcggcgcgttcggtcggttcgcggttgttttttgtaggtcgtttcgtcgtcgntcgttttcgtttttcgttttttgtcgcgtttcgggattttcgttagaggttcggtcgtttttcggtcgtttttgtttcgtttcgttcggattcgttttttttagttcgggcggttttcgtaggagtgggtatttggtgatatattttggaaaagatgttattaaaaaatagtttttgtttgtcgggagaattggggggttttcgggtgtgtatcgtgagggtggaggaggaagtatcgacgagtagtttgtattttatatatcggggagaaagtttaaatattaaacgtttgtaggtgtagtttgtttgggagttcgggtttttttttcgtcggtaatttattgtgtgattttgataaatcgttattgttgtcgggggtagagtttttttaagttttagttgcgagggttgggtaggtgatttttgatgtttttttaattttaattattttacgttttttatttttgtgggggtttattttttgttatttttttttttttttatttttaatattaatatcgatttattgttttttttttttaacgttatttttttttatataggttttttttattttttgttattagttattttttttaataatttgtttttttttttgagttcggggaggggataagatttgttatatttttttaatttttagttttcgggtggtggtatttttttttatgtttgtttttataaaaatttaaatggtattagagttaatttaaggaagacggtgggttgtatataaatggattttttaatttaatttaaaggagaggtttttattatgttagttttatttttagtatatatatatatatattatatatttgtatttatggatataaaattaatttagtgacgttagagtattttttattttaggattttttagcgttaggtcgagttttaattattttagtatttttttggtttcgtcggtttttttgttgttattagtttagttttattagcgggggttatagtttttttacggtttttagggtggggttttggttatatagtttgtttttggggaggggtgtgtgtgtgagtgtgtgtgtgtgtaagtgtgtgtgtgttagggggagttgttcggttaatcgtttagtttatattgggtagagttatttggcgagtgtgggattttgagttatagtttatttaagttgggttgtttttgtttatgttttagttttagttatttgtatttttagtgttgttggaattattttttttatagggggtattggagttcgtaatgtttggcggaggggagggtattttttttggggtttttggaattatggagatgagaagagtagttgggatgaaatttatggcgtgtagagtgtagtggtggtgttgagggtatgttatgggtgaagggagtttgtggtgtgtagtggtagttgtaatggggaattgaggttgtagcgtacggagtttttatgtagtaagcgaatttgtgtttagtttgggtttataggagataagtaatagttgtagtgtggggtaggaggttgtagtgtgtagagttagtgtagtgagtggaatgaggtgtattgagggtggttgtttgttagtcgatgttattttttcggtgattaggtttggtcggaattttggggagtaaggttgtagtatgtagtgtttagggtttgtattttattttgtatggaattagttttttggaattgggttgtttaaggagttgggagggaattttaatgtatgagatatatttatattttgtattataaaggtagaattaggaggtagtggggagggttagcggtaatttggattagggtaggagtgatggtgtttagagggggaggaaggaaggtgttacggttttgttttttttttatggcgttaagttgtggattttttgggttttggggtgggatttggttaaggggaagttttttggatttaagagttatttagttttgtatagtttgtcggttttttttttttttttgttaagtaaaaggtttatttattattttgtgttacgattgttttattttttttttttataataggatttttttgttagggtaaattatataatttggaagtagtggttattttaaatattgtggtttatagtgggagagagggaaagtatttattttagaagttgttttttttgttttagaaggttggtagttggaaggagggatttagttgttagggttttgaggtaaggattttgtaaatggtaattaattttgagggttttttttggattttttttagaattattgagtttaaagaaatatagggtttttatattatagttaagtttgggagtacgtggatttttgtatatttgatttttatttagttttcgtttttttgaaataaattagttgaaattcgaatttatttttttatattatttttttagttttttgtagtagattagtgtaggtttagtaagaatagggagtaggtagaaattatttttaaattttattaatagagattgggtttgttagggattattggtttttttttaaggggttattgtttaggtgtttttgtatttgattttttttgattttttgtttataaaaagtttttaaatgataaagtgagaatatagttttatggtattttttgttttagggtttagttttttaatgttatttttgtagtttgtttgtttgatgttattatttgtagatttgtgttagatttttaggtttttattttgaaattttagttttcgtatttagggtttaggggagagttaatgtaggttattgtagttgagtttgtagggttgtttgttttttgagtttagagttttttaggtatagagagaaagttttgtagagaagtaaaagaaagggttttgtgagaattagagaaaagtttattttttaaaaaatgaagtagggagaggttaggagttagttgtttagattgagatagtaataggagttttgtttttgagaattgtttgtgatggagagaaggtttaaggagaggggttgggtatggtttatattttttttaattttttaatttttatttgtttgtgtaagggaattttttggatttggtgtttattttttattttttattttttttttaggtttaggttttatttttaggagtttttgtgatttgttttagggattttttgttttttttggttatagtttttgggttttaggaaggtggagtaggttagggatgatttcgtttttttttattgaaagattttttttgtttgttatttgttaaatttattttatttagggaatttttaattttttgggattttatttttttttttggtttttttattttagtatttgagatcgtagggagtgtttgtgtgtgtttgtgtgtatggtttttatttttttttagttatttatgggaagttaagagtttatggttgttaattaatttggggtttttatggttagtaaaaatagataagggtttaatttttatttttagttttaaaataatttaagttataattatttgttttaataggagtttcgggataggaagaaaagtaggtaagatggagaaaggataaataaataaaattttaatttttttttttttttattttttttttatttagtattttttatttttttttgagattttagttatttattagtttattattgttgtgttatttgttcgtatttttagaatttgtatataggaggtatttaataaatgttttttattttgagttaaattaaatttgattacgttttgtggttggattttgagatgaagtagtataaagggggaaggtagatatgtttttagatttttttttttttttttttttttgagatagggttttattttgtcgtttaggttggagtgtagtgtgtgattttggtttatggtaatttttattttttagtttaaggaatttttttgttttagttttttgagtagttgggattataggtatatattatattcggttaatttttgtatttttttgtagagacggggttttattatgttgattaggttggtgtttaatgcgtggttttaagtgattcgtttgttttagttttttaaagtgttgggattatagggatgagttattacgtttagttgatatgtttttagattttgggttagatttttttagaggattgattgttagggatcgaagatttaaagtagtgggttttaggttttttagaattttaagggttttgttaaaatttagattgttgggttttgtttttagagtttttgatttaatttatttgggatggggtttgggaatttgtatttttaatatgtttttaggtgattttagatttttatgtttattttgagaattattgttttagagaattttagtttttttttttattgtttattatgaggatttgattggttttattttttttttttttttgagatagggtttcgttttgttgtttaggttggagtgtagttgtatgatttcggtttattataattttcgtttttcgggtttaagcgatttttatgttttagttttttaggtagttgggattataggcgtttattattatgtttggttaatttttttttattttttgtagagatggggttttattatgttggttaggttggtttcgaattt

SEQ ID NO: 167 - DNA, 5134 bp, Artificial Sequence
  chemically treated genomic DNA (Homo sapiens)
  unsure (30, 33, 37, 42, 45, 47, 49, 53, 56..57, 315, 422, 1807, 2267)
  unsure (2611, 2623, 2734, 2746, 2763, 2782, 3189, 3733, 4673)
ttttttttttttttttacgcggattttgantgntagngtcgnatngngngggnaannaatgtttcgtgtttgttttaaaatgcgttttgtgttgtggggtgcgttttttgtggcggttttttcggtagttgagttaggagaattttttggattcgggaagtagaggttgtagtgagttgagatcgcgttattgtattttagtttgggtaatagagtaagatttagttttaaaaaaaaatgtggttttattgtttttttttttttttgggatagggttttattgttatttaggttggtatgtaatgatgtaatttntagtttattgtaatttttgttttttaggttgaagtaatttttatgttttaggttttcgagtagttggaattataggtgtttagttaatttttgtatttttttgtagnagatagggttttgtcgtgttggggaggttggttttgaatttttggttttaagtgatatatttgtttcggttttttaaagtattgttttttaggaatagtgatcgtattttatatttagtagcggatggggaacgtttttttgtttattttatttttttatgttaattataggggggggttttacgggtttgggtatggatggttgagtaagaaaggttaggtttggtcgattgagtcgtggatttttttcggattttttttgtttttagtagtttttgtagtaaggggttttgggtatttgtttttgagtagggaggtttataaagtgtttggtgtttgggaaatgtttttcgaggtttaggtggtgtagtatagtttttttttatttttagtattttgaattattggtatatgtttaaggatatttaatgcggttacggggaggttatattagtatttttaatttttatttgtgagtaggtttttaaggttttttttgtttttagtcggataatttatcggttgggatagtattgattttttagtttttgtagggtataaatatgaggtttcgtaagatttttttttttaatagagtgtgtttttttttttcgtttatgttcggttgtttttttttgttttagaagttttcgttttagtattttagggtttttaagatgtttttagatttatggtttagaggtatattagcgatcgttgtgtttttagttagttggtagttttaaggggagatgaggttttttaaacgaatttagttaatgttattatgggtattatttttatagtagttacgattaggggaggttaggtggttcggtggtttacgtttgtaattttagtattttgggagtttgaggtaggtggattatttgaagttagaagtttgagattagtttggttaatatggtaaaattttatttttattgaaaataaaaattagtcgagcgtggtggtgtgtatttgtaattttagttatttgggaggttgaggtaggagaattgtttaagtttgggaggtggaggttgtagtgagtcgagatcgtattattgtattttagtttagcgatagagtaagattttattttaaaaaaattaaaaaaggaggagttgatttgcgttgagagggtgcgattttgattataggaggttattgtatagttaaaggtatagaggtgaggaggaaggaatgaaaggttagtttgtaaatgttggtaggttttatggttgatatatagaggtgaggttgggaggttgggttggaggaggaggggcggtgaatgtcgggttaatatttttatattttatgtagaaagtaataaggaattattttgaggtagtttggagaattaaaaaaagaaaaaaaanaaatagaggttgggcgcggtggtttacgtttgtaattttagtattttgggaggcggaggcgggattacgaggttaggagtttaagattagtttgattaatatgatgaaattttatttttattaaaaatataaaaattaattaggtatggtgacgcgcgtttgtaattttagttatttaggaggttgaagtaggagaatagtttgaattagggaggtagaggttgtagtgagtcgggattatgttattgtattttagtttgggcgatagagtgagattttattttaaaaaaaaaaaaaaaaaaattaatagaaaatgttggatacggtggttttcgtttgtaattttagtattttgggaggttaagataggtagattatttgagtttaggagttttagattagtttgggtaatatggcgaaatattatttttacgaaaaatatgaaaaattaatcgggtantggtggtggatatttgtagttttagttattcgggaggttaaggtaggagaatcgtttgagtttaggaagtagagattgtagtgagttaagattgcgttattgtattttagtttgagagagtaaaattttgttttaaaaaaaaaaaaataaaatattgggcgtggtggtttatatttgtaattttagtattttgggaggttgaggcgggtgaattatttgaggttaggagttcgagattattttggttaatatggtgaaatttcgtttttattaaaaatataaaaattagttgggtatggtggcgggcgttcgtaattttagttattcgggaggttgaggtaggnagaatcgttggnaattcgggaggtggaggttgtagcgagttgagattttattattgtattttagtttgggtgataatagcgagattttattttaaaaaaaaaaaaaaaaaaaagtaataaggnaattagattttngaagaaagggtttaaanattattatgagaaatgggnaagttagggtagttttatggtaaggtttgaggttaaatgttatttgattttttttatttatttattgttttatttttaataagttatttagtttttgagatttagttttttgattggtagaaggtatttatttaggttcggtatagtggtttatatttgtaattttagtattttgggaggtcgaggcgggtggattatttgaggttaggagtttaagattagtttgtttaatatggcgaaattttatttttattaaaaatataaaaattggttaggcgtagtggtttatgtttgtaaatttagtattttgggaggttaaggggggcggattatgaggttaggagttggagattattttggttaatatagtgaaattttatttttattaaaaatataaaaaaattagntcgggtatggttgcgggcgtatgtagttttagttatttaggaggttgaggtcggagaatggcgtgaattttggaagaagaggttgtagtgagtttagatcgcgttattgtattttagtttgggcgatagagcgagattttgttttaaaagaaaaaaaaaaaaaattagttaggtatgtagtattagttatagtgtgtttgtaattttagttattcgggaggttgaggtaggagaattatttgaattcgggaggtagaggttgtagtgagtcgagattatgttattgtattttagtttgggtgattgagcgagattgtgttttaaaaaaagaaggtatgtatttaaattataaggttaaaagagataaagtatgcgagtaaaataaagtaagttagttagtgtgggttgttttttttttttagtgaaggagttttttgttagaggtttttggatttgtttaatttgtatttggaaaggttattatttgtaggatttttatagttatatttggtatattttgtgattattattattatttttgttngttattatttatgattatgattatataatgggttttttttttttttttttttttttttttgagttatcgtattcggtttgtatgtttttaatttttataattttaatgtaaatattagttgttttgaattttttagtttgtgttatataagtatagatttaaaaatattgtgtaattttagattaaggtttagaattttgttttttaattttttgcgggtttatggatttttttttttttttttttttttttttttgagattaagttttggtttatcgtttaattttttaggttggagtataaatggtatgatttcgggttattgtaatttttattttttgggtttaagcgatttttttgttttagtttttttagtagttgggattatagaggtatattattacgttcggttaatttttgtatttttagtagaaacggggttttattatgttggttaggttggtttcgaatttttgatttcgtgattcgttaaaagtgttaggattataggtgtgagtcgttacgtttggtagggtttacggatattattagtatagttaggattttaattttttttattttgaaaattaggttaataaaaatttttaggagaaggtaaaatatattatggtgtttaagtattggggatttggtacgtattaggcgttttgtatgtttataggagtgttttagacggtttttaagttttttttttggaattttaatttaataaatgagttaatttcgttttagttttttagtttttttttgtaatttatttatttttgtagatattttgttttaaggaattttgtttgggaaatttatattagatatatttattatggcgtttatagtcgtatgggcgtgcgtttttttgtttatatggttagagtttcgtttcgtttcgtttttttaaatttggtgggcggatcgaggncggggttttatattaggttttatttcgattagttacgtttatcgttttgatttttaggtttttttagtttttgggcgtacgtgtcggattttttttacgagggggcgggttgcggttaaatttttcgttaggttagcggtcgggcgttgattggttttatggcggcggggtcggttcgtgattggttagtacgtcgtggtttaaagcggtcggcgcgggaattaggggtttattgcgggacggttttggagagtattcgggttcgtgaatttttcggaggcgtaatgagttgtattaatttgtttattgtgttgtttggtttttttagtaagattcgggggtagatttaggtgcgggggttagttttgcgcgtggttggggatgaggtggtcgtggtgatagtttgtgtttacgtattcgcgtagggcgggtttttaaatgattttatttttttttttagg

SEQ ID NO: 168 - DNA, 5134 bp, Artificial Sequence
  chemically treated genomic DNA (Homo sapiens)
  unsure (462, 1402, 1946, 2353, 2372, 2389, 2401, 2512, 2524, 2868)
  unsure (3328, 4713, 4820, 5078..5079, 5082, 5086, 5088, 5090, 5093)
  unsure (5098, 5102, 5105)
tttagaggagagggtgaggttatttgagggttcgttttgcgcggatgcgtggatataggttattattacgattattttatttttagttacgcgtagggttggttttcgtatttggatttgttttcgggttttgttgggggagttaggtagtatagtgggtaggttaatgtagtttattgcgttttcgggaagtttacgaattcgagtattttttaaggtcgtttcgtagtaagtttttggttttcgcgtcgatcgttttaaattacggcgtgttggttaattacgagtcggtttcgtcgttatggggttaattagcgttcggtcgttgatttggcgggagatttggtcgtagttcgttttttcgtgggaggaattcggtacgtgcgtttagggattgggagggtttggaaattagggcgatggacgtggttgatcggggtggggtttggtatgaagtttcgntttcggttcgtttattaagtttaaaggggcggagcgaggcggggttttggttatataaatagagggacgtacgtttatgcggttgtagacgttatgatggatgtgtttggtgtgggttttttaagtaaggttttttggaataagatgtttgtagaggtaggtggattgtagggagggattaaggggttggggcggagttagtttatttattagattggaattttaagaaggaagtttagaagtcgtttagagtatttttgtgggtatgtagagcgtttagtgcgtgttaggtttttagtgtttgagtattatggtgtattttatttttttttaaggatttttgttaatttggtttttaggataaagaaaattgaagttttgattatgttaataatattcgtagattttgttaggcgtggcggtttatatttgtaattttagtatttttggcggattacgaggttaggagttcgagattagtttggttaatatggtgaaatttcgtttttattaaaaatataaaaattagtcgggcgtggtgatgtatttttgtaattttagttattggggaggttgagataggagaatcgtttgaatttagaaggtggaggttgtagtgattcgagattatgttatttgtattttagtttggaaggttgggcgatagattaagatttagttttaaaaaaaaaaaaaaaaaaaaaaaaaaaaatttatagattcgtaggaggttaggggataaagttttggattttgatttgaggttatataatgtttttgggtttgtgtttatgtggtataggttgaaggatttagaatagttggtatttatattggggttgtgaaggttagaaatatataggtcgggtgcggtggtttaaaaaaaaaaagaaagaaagaaaagaaatttattgtataattatgattataaataatagtnaataaagatggtggtagtgattatagagtgtgttaggtgtggttgtaaggattttataggtaataatttttttaggtatagattggatagatttaaggatttttgataaagagtttttttattgggaggaagaagtaatttatattgattggtttgttttattttattcgtatgttttattttttttaattttgtgatttggatatatgttttttttttttgagatatagtttcgtttagttatttaggttggagtgtagtggtatgatttcggtttattgtaatttttatttttcgggtttaagtgatttttttgttttagtttttcgagtggttgggattataggtatattgtagttggtattatatgtttggttaatttttttttttttttttttgagatagagtttcgttttatcgtttaggttggagtgtagtggcgcgatttgggtttattgtaatttttttttttagggtttacgttatttttcggttttagttttttgagtagttgggattatatgcgttcgtaattatgttcggnttaatttttttgtatttttagtagagatggggttttattgtgttagttaggatggtttttaatttttgattttatgattcgttttttttggttttttaaagtgttgggtttataggtatgagttattgcgtttggttaatttttgtatttttaatagagatggggtttcgttatgttggatagattggttttgaatttttggttttaagtgatttattcgtttcggttttttaaagtgttgagattataggtgtgagttattgtgtcgggtttggatagatattttttattagttaggaaattgaattttagagattaagtaatttgttgaggataaaatagtaagtaagtgagggaggttagatggtatttgattttaggttttgttatgaggttgttttgatttntttattttttatgatggtntttgagttttttttttnaaaatttggttnttttgttatttttttttttttttttttttgagatggagtttcgttgttgttatttaggttagagtgtaatggtgggattttagttcgttgtaatttttatttttcgagttnttagcgattttntttgttttagtttttcgagtagttgagattacgggcgttcgttattatgtttagttaatttttgtatttttagtagagacggagttttattatgttggttaggatggtttcgaatttttgattttaggtgatttattcgttttagttttttaaagtgttgggattataggtgtgagttattacgtttagtgttttgtttttttttttttgaaatagggttttgtttttttaggttggagtgtaatggcgtaattttggtttattataatttttgttttttgggtttaagcgatttttttgttttagtttttcgaatagttaggattataggtgtttattattantgttcggttgattttttatatttttcgtagagatagtgtttcgttatattgtttagattggtttggaatttttggatttaagtgatttgtttattttggttttttaaagtgttgggattataggcgagagttatcgtgtttagtattttttgttggtttttttttttttttttttgagatggggttttattttgtcgtttaggttggagtgtagtagtatgatttcggtttattgtaatttttgtttttttggtttaagttatttttttgttttagttttttgagtagttgggattataggcgcgcgttattatgtttggttaatttttgtatttttagtagaaatggggttttattatgttggttaggttgattttgaatttttgatttcgtgatttcgttttcgttttttaaagtgttgggattataggcgtgagttatcgcgtttagtttttgtttnttttttttttttttttaattttttaaattgttttagaatggttttttgttattttttgtataaagtgtgaaggtgttagttcgatatttatcgtttttttttttttagtttagttttttagttttatttttgtgtgttagttatagggtttgttagtatttgtaaattgattttttatttttttttttttatttttgtgtttttgattgtgtagtgattttttgtggttagaatcgtatttttttagcgtagattagtttttttttttttaatttttttgaggtagagttttgttttgtcgttaggttggagtgtagtggtgcgatttcggtttattgtaatttttattttttaggtttaagtaatttttttgttttagttttttaagtagttgggattataggtgtatattattacgttcggttagtttttgtttttagtagagatggggttttgttatgttggttaggttggttttaaatttttgattttaagtgatttatttgttttaggtttttaaagtgttaggattataggcgtgagttatcgggttatttggttttttttggtcgtaattgttgtgggagtggtgtttatgatggtattaattgaattcgtttgggggattttatttttttttaaggttgttagttggttaaaggtatagcggtcgttggtatatttttagattatggatttgagggtattttggagattttgggatattggggcgagggtttttaaggtagagaggagtagtcgggtatgggcgagggggaggggtatattttgttgagaaggaaagttttacggagttttatgtttgtgttttgtaggagttggagaattagtattgttttagtcgatgggttgttcgattgggagtagaggaagttttgaggatttatttatagataggaattgaaggtattagtgtgattttttcgtggtcgtattgggtgtttttaagtatgtgttagtgatttagaatgttgggggtgggggggggttgtgttgtattatttgggtttcgaggggtattttttaaatattaggtattttataaatttttttgtttaggggtaggtgtttaggattttttgttgtagggattattggaggtaggagaggttcgggggaggtttacggtttagtcgattaggtttggttttttttgtttagttatttatatttaggttcgtaaggtttttttttgtggttggtatagggaggtgaagtgaatagaggaacgttttttattcgttgttgaatgtggaatgcggttattatttttaaaaagtaatattttgggaggtcgaggtaggtatattatttgaggttaggagtttaagattagtttttttaatacggtaaaattttatttnttataaaaaaatataaaaattagttggatatttgtaattttagttattcgggaatttgaggtatgagaattgttttaatttgggaggtagaggttgtagtgagttgnagattatattattgtatgttagtttgggtaatagtgagattttgttttaaaaaaaaaaaaaagtaatgaagttatatttttttttgagattgagttttgttttgttgtttaggttggagtgtagtggcgcgattttagtttattgtaatttttgtttttcgggtttaagagatttttttgatttagttgtcggagaagtcgttataagaggcgtattttataatataaagcgtattttaaaataaatacgaagtattnnttntttntntnatncgatnttantanttaaggttcgcgtagggggagggaggaga

SEQ ID NO: 169 - DNA, 5610 bp, Artificial Sequence
  chemically treated genomic DNA (Homo sapiens)
tatattatagatttatttataagaagatagatggaattattttttttttttgaattttagaattttaaggaagttaatttgagtggtttagtttggattaagtgtttattttggtttaaataattgtagtagtatatttgtgtatttgtgtattttgtttttttataattttgtagttcggggaaagtgtgtagatggatgggtttttgaaaagtaagagttgtttagataacgttagaggtgtttagttttgggagataagagttgggttaggttgataattagtttaagagagtcggaattagatgaataagaattagattttgggtgataatttagattaagagttttgaggtttagttattttaaaaagtttaagttttattgttttttggttttttggttaagattatgtgtagtatttgtttttattagtttaatatttgatatattttttatttgaggataatataataaatagatttttggagtaaggagatggaataggagtttgttttgtttattttatatattggtttggattgtagtatttttaggaatggtgtattttttttattatttttaaaaagtttaagttttaagaggtagtttggaaaaaagtgtttttggatttatttatatttttttttttaagatggagtttcgttttgttatttaggttggagtgtagtggcgttattttggtttattgtaatttttgtttttaggatttaagtagtttttttgttttagttttttaagtagttgggattataggtgtgtgttaattatgtttagttaatttttttatttttagtagagatagggttttattatgttggttaggtaggttttaaagttttgattttaggtgatttgtttgttttggtttttcgaagtgttaagattataggcgtgagttattgcgttcggtttaatttttgtaattttagtagagacgagtttttattatgttgattaggttggtttcgaatttttgattttaggtgatttattttcgttttcggttttttaaagtgttggtattataggtatgagttatcgtttttggtcgggtttgtttatattttggagatgttgtatattatgtttttttttttaagagttacgtaagtatttatatatggaagattttgagaaggtatttgggaaaaaatttgtttaattgtaaatataataatgtatgtatttgtatgtggagttttttttttagtggattatttataaatcgtttattgtttttaatgtatattttggagatagatttatattattagtttttatttgttagttatttttataagggttgggatggtttatgagtgaatagttttgatttaaagtagtgttttttaaattttatttatttgtttatagtttttttggagtttgttttatatgttcgttttgtgtattatttttatatgtttttatgtaaattaattatttttttaaaaagttttattttagttatatttttaaaataatggttatttttttttatatatatcgaaatatatatttattagaattaaaatgtttgtttatgtattattaataatttttttaagtattatatggtggggatatgtgtttgaagtgttaggagttaggagtggtttttgtaagatagagtaagttagttaatttttgagtattgttagttatatatgttggtagagaagtttagtttgtgataagattgttcggatatttttatgtttgtgtacggggatgttttcggtttgttattgtgaagtttgtgttgtttttatgtttatttagttttttttggaggggtttggaaagtaaatgtaggttgggtatagtggtttatgtttgtaattttagtattttgggaggtaaaggtgggtagattacgaggttaggagtttgagattagtttgattaatatagtgaaattttgtttttattaaaattgtaaaaattagttgggtgtggtggtacgtggttgtaattttagttattcgggaggttgaggtaggataattgtttgaatttaggaggcggaggttgtagtaagtttagatggtattattgtattttagtttgggtgatagagattttattttaaaaaaaaaaaaaaaaagaaaaaaaagtaaatgtagattttttttgggaaacggggggttgggagagtggagtagtgtggatgtattgttatttttgaaggtcgtttttaaattattttggatttattgtagtaagtagatgttttattttttggttagggattgattttgagatgggaagagtatgagaagagatattaatagtaaggtaaaattggttttggtagtttgttttagagaaagagtatagttttggagttaggtcgatttgagtatgaatttaagatttagtatttattaggtgtttgtttttaaattattattttttgatagttattatatatttataatgattattatggagtggatgaggaaatagggatttagagaagttaaataatttgtttgatattatataggtaataaatagtagagtagaatttaaatttaagttgatttgatttttaaatgtgtgtttttaattaaagtagggtaatttgttttgatttgtttattttttgagtattttttttgtaggagggtttgttgttgggtgttgggaatttagtggtaggtaagatggataagattttttttttttatagattttgtttgttataggggaaatagataggaaattaattattatatttgtaatttaataataagtgttataagtgttataaaggagatagatattataaggtattttttatttttatttgtttatttattttttgagatttattcgttttgttgtttaggttggggtatagtggtgcggtttcggtttattgtaatttttgttttttaggtttaagcgatttttttgttttagtttttcgagtagttgggattataggtgtgaattattatattttgttaatttttgtatttttagtagagatagggttttattatgttggttaggttgttgttgaatttttgattttaagtgattgatttatattgattttttaaagtgttgtgattataggcgttagttatcgcgtttggtttataaggtatttttggttagttagtggaagtagggttagtagtgcgtcggagagttattttgaaaaagtgatatttaggttgattttgaagtatttataagatgtggtaaatatatttaatggtaaatatgtgatggtaaatattagatgtgataaagatattgatggtttattggatgaatagtttttatatttatttttaaatgattttatagatattattttatagataatatttaggatgaaggtaaataaaaaggagattaattaaaatatgaaataataatagtgaaagtggtaatagatgtggtaatatttataaaggagtaatggttagattagtatattgagaagattattttggtaattgttggaatgtagtttacgagagggttaagaatggaagtagtaatttttgttagaagtgtagtgttttggagtgcggtgttttttgttggtttgttttttgttttttttaaattaggttttattttgttgtttaggttggagtgtagtgtagtttcgatttttttttcgggtttaggtgatttttttattttagtttttcgagtagtcgggattataggtatatgttattatatttcgttagtttttgtatttttttgtagagttagggttttgttatgttgtttaggttggttttgaatttttgggtttaagtgatttgttagtttcggttttttaaagtgttaagattataagtgtgagatattatttttagttagtatattgtattaatttaagtaggagaacgtagattttaaaggtttatgggtagtagagagaagtagatgaagtaaagagatgtaattagcgggattagtgggaaatgagggaaaggaaggtgttaggatggggttttttttagttgagtggagtttagtttatttttagagaagtttgagaggtatttaattatagatgtaaggtagttggttgttggttttttgtttttaggatagtttgatttttgtaatataggcgattttatagagttattgtgagaatttagagttgggtatagaatagatgttttataaacggtagttttattttttatttgtttcgtttttttagtatgttagggatataggggcggatagagataggtttagttttttttggttttttgtattttttttttttttagtataatttttgggtttatagcggatgtttaataagtatttgtagaatgaattaaagaaattagatttttggtgatttagggttatatgtattcggcggaaaattggggttaaatcggatttttggttggttgaaaaattaaaataatttttaaaaagtgggcgtgaaataatttagaagttggagggtttggataaaggttggggaggggattttttttattaggcggttttagggtcggtttagtaagaaaggaggcgttggggagatttttggggttttagttgttaaggtattcgtcgttttaaggagatgcggacgtcggatattagttttgtttaagattgttgggtttcgtcgcggtttttaaaggtttattacgtggttgcgcggttagttttggttcggaggcggtgttcgggtggcgtttgcgtattgtttagtagaggggttggggtttcgagaaaaagcgtttggagaggaaggggaggttgtttggggtgggacgtcgtgggaggagtcggttttttatgtaaattatagcggagcgcgtacggttcggaggcggggtttgcgatgtaaagataggttcgtttggcgaatagcgagggggcgggtcgtaattttttgttttttttcgcgagcgttgacgtcgtcgacgtgttgtttaaaagcggtcgcgtaggcgtagtgagtttaaatgcgaatttaggttgttatataattgttggggtttgttttcgtcgttcgttcggtagttaggtagcgtcgtcgtcgtggtagtagttttagtcgtttttggagtttcgggtttatagttatcgtcgtttatttgcgttttttcgagttttcggagttttcgttcgttcgtataggtcggttcgtcgtttgcgttttttttacgtcgtttcgtttgtcgtcgcgttcgttttttcgggtcgatatgagtggggattatttttataacgatttttaggtacggttcggtttgattttggcggtttcggatttcggtttggtcgtttcgcgattttcggcgtaggtttcgattttagtttcggttcggtagttttgataggtcggagttttcggtgaggggtcgtttgtcggagtagatcggttcgttaggtcgcgagcgagggtcgcgaagttatagttcgaggtagggatggttgttttttgtggttattttcgggttttcgtttttttcgggggcgtagggtgagttagatttcggtcgcgcgcgttcgtcgtcggaggggttaaagtggttgttgtttgatattttttttttttttttttttaga

SEQ ID NO: 170 - DNA, 5610 bp, Artificial Sequence
  chemically treated genomic DNA (Homo sapiens)
tttggaaaaagaaaaggagagaatattaaataatagttattttaattttttcggcggcgagcgcgcgcggtcggggtttggtttattttgcgttttcggggaggacggggattcgggggtggttatagagggtagttatttttgtttcgaattgtaatttcgcggttttcgttcgcggtttagcgagtcgatttatttcggtaggcggttttttatcgggggtttcggtttgttaaagttgtcgggtcggggttggggtcggggtttgcgtcgggggtcgcgggacggttaggtcggggttcggggtcgttagggttaggtcgggtcgtatttgggaatcgttgtggaggtggtttttatttatgtcggttcggagggacgagcgcggcggtaggcgaggcggcgtgggggagacgtagacggcgaatcggtttgtgcgggcggacggggatttcggaggttcgaggaggcgtaggtaagcggcggtgattgtgggttcgagattttagaaacggttgaggttgttattacggcggcgacgttgtttgattgtcgggcgggcggcgagaatagattttagtagttgtgtaatagtttaagttcgtatttgggtttattgcgtttgcgcggtcgtttttaaataatacgtcggcgacgttagcgttcgcggaaagaggtagagggttgcggttcgttttttcgttgttcgttagacggatttgtttttgtatcgtaagtttcgttttcggatcgtgcgcgtttcgttgtgatttgtataaggagtcgattttttttacggcgttttattttaagtagttttttttttttttttagacgttttttttcggaattttagtttttttgttaggtagtgcgtaggcgttattcgggtatcgttttcggattagggttggtcgcgtagttacgtggtgggtttttaaaggtcgcggcgggatttagtaattttgggtagagttggtattcggcgttcgtatttttttggagcggcgagtattttggtagttgggattttagaggtttttttagcgtttttttttttgttaagtcgattttgaggtcgtttggtgggaggagttttttttttagtttttgtttaggttttttaatttttggattattttacgtttattttttaaaaattattttaattttttaattaattaagggttcggtttaattttagtttttcgtcgagtatatgtagttttgggttattaagggtttgatttttttggtttattttataaatatttattgagtattcgttatgagtttaggaattgtgttgagggaagggggaatgtaagagattaaagggaattgaatttgtttttattcgtttttgtatttttggtatgttgggaggacggggtaaatggggaatagaattatcgtttatagagtatttattttgtgtttagttttgaatttttataatagttttgtgaggtcgtttgtattataaaagttaaattgttttaaagataagggattaatagttagttattttgtatttatagttggatattttttaagtttttttgggaatgaattgaattttatttagttagaaaaagttttattttgatattttttttttttttattttttattagtttcgttgattgtatttttttgttttatttatttttttttgttgtttataagtttttgaagtttgcgtttttttgtttggattaatataatgtgttggttgggggtggtgttttatatttgtaattttagtattttgggaggtcgaggttggtagattatttgaatttaggagtttaagattagtttgggtaatatggtagaattttgattttataaaaaaatataaaaattggcggggtgtggtggtatgtgtttgtagtttcggttattcgggaggttgaggtgggaggattatttgagttcgaggaggaggtcgaggttgtattgtattttagtttgggtaatagagtgagatttggtttaaaaaaaataaaaaataaattaataaaaaatatcgtattttaaaatattatatttttaatagggattgttgtttttatttttggttttttcgtaaattgtattttaataattgttaaagtgatttttttaatatgttaatttaattattatttttttgtggatattgttatatttattattatttttattattattattttatattttaattgattttttttttatttatttttattttaagtgttatttgtgaaataatatttatgaaattatttggaagtaaatatgaaaattgtttatttagtggattattagtatttttattatatttaatgtttattattatatgtttattattagatgtgtttattatattttgtgaatgttttaagattaatttaaatattatttttttaaagtgatttttcggcgtattattgattttgtttttattggttgattaagggtgttttataggttaggcgcggtggttaacgtttgtaattatagtattttgggaggttaatgtggattaattatttgaggttaggagtttaataatagtttggttaatatggtgaaattttgtttttattaaaaatataaaaattagtagagtgtggtggtttatatttgtaattttagttattcgggaggttgaggtaggagaatcgtttgaatttgggaggtagaggttgtagtgagtcgagatcgtattattgtattttagtttgggtaatagagcgagtgagttttaaaaaataaataaataaataaaaataaaaggtgttttatagtatttattttttttgtaatatttatgatatttgttattaagttataaatgtagtaattggttttttgtttattttttttatagtaagtaaggtttgtgagaggggggaattttgtttattttgtttattattgaatttttagtatttagtaataggtttttttatagaagaggtgtttaagaaatgggtaaattaaagtaggttattttgttttggttaggagtatatatttggaagttaaattaatttaggtttgaattttgttttgttgtttgttatttgtgtgatattaggtaagttgtttaatttttttgagtttttgtttttttatttattttatggtgattattgtgggtatgtaatgattattaaaaaataatggtttgagggtaggtatttagtaagtgttgagttttggatttatatttaggtcggtttgattttaaagttatattttttttttgaagtaagttgttagagttagttttgttttgttgttggtgtttttttttatattttttttattttaggattaatttttggttagaagatgaggtatttgtttgttgtagtgagtttaagataatttgaggacggtttttaggaataataatgtatttatattattttatttttttaatttttcgttttttagggagaatttgtatttgtttttttttttttttttttttttttttgagatggagtttttgttatttaggttggagtgtagtggtgttatttgggtttattgtaattttcgttttttgggtttaagtaattattttgttttagtttttcgggtagttgggattatagttacgtattattatatttagttaatttttgtaattttagtagagataaggttttattatgttggttaggttggttttaaatttttgatttcgtgatttgtttatttttgttttttaaagtgttgggattataggtatgagttattgtatttagtttgtatttgttttttaggtttttttaaagaagattaggtaggtatgaaaatagtatagattttataatggtagatcgaggatattttcgtgtatagatatggaaatattcgggtagttttgttataggttgaatttttttgttagtatgtgtggttggtagtgtttagaggttgattgatttattttgttttatagagattatttttgatttttaatattttaaatatatgtttttattatatggtatttgaggagattattgatagtgtatggataagtattttaattttaatagatatgtatttcgatgtgtatgagaaaaaataattattgttttaaggatataattgggatgaggttttttaaaaaagtgattgatttatataaaaatatataggaatagtgtatagagcggatatataagataaattttaggaaggttataggtaaataaatgaggtttgggaaatattgttttaaattaagattgtttatttatggattattttaatttttataaaaataattagtaggtgaaaattggtagtgtaggtttgtttttaaagtatgtattgggaatagtggacggtttatagataatttattaaaagaagagttttatatataaatatatatattattatatttatagttaaataggtttttttttaggtgtttttttagggttttttatatgtaaatatttacgtgatttttgaaaagagggatatggtgtgtagtatttttaaaatgtaggtaaattcggttaggagcggtggtttatgtttgtagtgttagtattttgggaggtcgagggcgggggtggattatttgaggttaggagttcgagattagtttggttaatatggtgaaaattcgtttttattaaaattataaaaattaggtcgggcgtagtggtttacgtttgtaattttagtatttcgggaggttaaggtaggtagattatttgaggttaggattttgagatttgtttggttaatatggtgaaattttgtttttattaaaaatagaaaaattagttgagtatggttggtatatatttgtaattttagttatttgggagattgaggtaggagaattgtttgaattttggaggtagaggttatagtgagttaagatggcgttattgtattttagtttgggtgatagagcgagattttattttggaaaaaaaaatgtaggtaaatttaaaaatatttttttttagattattttttgagatttgggttttttgggggtggtagagagggtgtattatttttggaggtattgtaatttaggttaatgtgtagagtggatagagtaagtttttattttatttttttgttttaaaaatttatttattatattatttttagatagaggatgtattagatattaaattggtaagaatagatattgtatatgattttagttagaaggttaagaagtaatgagatttgagttttttgaaatgattgaattttaagatttttgatttaggttgttatttaagatttagtttttatttatttgatttcgatttttttaggttagttattaatttggtttaatttttgttttttagaattgaatatttttagcgttgtttaaataatttttgttttttagggatttatttatttgtatatttttttcggattgtaagattatggaggaataagatatataaatatatagatgtgttgttatagttgtttggattaggatgggtatttgatttaagttgagttatttaggttaatttttttaaggttttagaatttagaagaaaagagtggttttatttgtttttttgtggatagatttgtagtatg

SEQ ID NO: 171 - DNA, 6069 bp, Artificial Sequence
  chemically treated genomic DNA (Homo sapiens)
  unsure (4665)
atatatgatagattgtgtattttgttggtgaagggtaggtgtatgataatatttaatgttttttaaagtagaatttttttaaaataagatgtatttttgaaagtttatttaattattagatatttttataaaggttaagagtaatttttttaagatatatgttaattttattttttacgttgtatgaaaattttgaattattattgagaattttgaattattgagaattttgaatattattgagttatattatataagtgaaagtgttttttttgtttgtataattagaatgttattagaagattagtgtagtttatttgattaaaattaatttaaataaatttttgtaaaataaaaaattaaaataaatattgtattttgtaattattgtaggtagaaattgaagaattttatttgttgtttgtttttttagtggtaataatatttaggaatatgattattgatatttttagttattcgtaaatatttgttatttttggtgtttaaatattattttaaaagtaaaaatatatttataaattgtagtaattaaatagttagaagaagtagagttaataatgtattataatatttattagagaaatattgaaaattaaaaagttatattgatagtaattttttttttttgagtttatttttaaagaattataataaattaaattatatttaaatatataatagttattaattaggtaattatttattgagtttattataggttagatattaaaaattttttttagtttagtaattttgtatatcgtaaggatttataaaattaatgtaatgagaagggagaggtgaaattatagatattgaattttgaatttaaatgttagtttttttaaatgttttcgaggttaaagatttgtttttttttttttaattgaattttagtgttggaatgatatataatatttaaatggaaattattgaaattttggtagatatttagaagtatggttttgagttgttatttttttggataatttatttattgattaaattatttattgtgtataaagtgtgatgataggtgtggtttattaggtaaattgtttattttttatgtatatatatatttttgagatggagttttgttttgttgttcgggttggagtgtagtggtgtagttttggtgtattgtaattttcgtttttcgggtttaagcgatttttttgttttagtttttcgagtagttgggattataggtatatgtttagttaatttttgtatttttagtagagatgcggttttgttattttggtaaggttagttttgaatttttgattttaggtgatttgtttgttttggttttttaaagcgaggtaaattgtttattaaatagtaaatgaataaatataaaattgttttttaattaaatgattagtttgaaattataatttaagggtgaatttaaggtagaaaatgcgtttttattatttttttaaatttttaggttttgagtatttaatatagtaggtatttaattttttttttattgttataataaggaaatataagatttaaaaatagaaattttgaagtagttaggataagtttttatggaagttatttagaaattttgattaaataaagatttttatatagtttatagaaatgattaatttttagtttttttttttggttagtgtttgttgtggggtagaaattaagttattatatgtaatatatatatataaagtagtatttaaaattagataaatttgatatagaagtttttttttttttttttttgagatggagtttcgttttgtcgttaaggttagagtgtagtggtgcgatttcggtttattgtaatttttgttttttaggtttaagtgatttttttatgtttgtttttttagtagttggaattataggtataggttattacgtttggttaatttttgtatttttagtagagaaggggttttatgatgttcgttaggttggttttgaatttttgattttaggtgatttatttttaattgaaaattattttatattattttagaagagaaagttatgtttaagttgcgtataattaattttattataaagatatgttaagtttgttgtatagttaaaaaggataattttttagaagttgagatatttttaatttagatttcgttttttatttattataaatttttgttttaaaaatgttgatttttatgtatatttagtaatttttatttgtaatttttttgggtaagttagtatttttttaaaattagtaatatttattaaaaggtttttttatattgagaagataaaaggatttaatgttttatatatgaggtaagtgaaaagaatattatttttattaatttatttgagttttgaatatattgttttatttattttaaaatttgaatttaggttgggtgcggtggtttatgtttgtaattttagtattttgggaggttaagatgggcggtttatttgaggttaggagttcgagattagggtggttaatatggtgaaaatttcgtttttagtaaaagtaaaaaaaattagttaggtatggtggtcggtgtttgtaattttagttatttgggaggttgaggtaggagaattgtttgaatttgggaggtggagggtgtagtgagtcgagattatgttattgtattttagtttgggtgatagagtaagattttgtttttaaaaataataataaaaacggaagataaagagttttgataatttaagtttaaaaaaggagatagttatgtattttatagtttagtttttatttagtatatttttataaaaaaaatttattgtttttaaaattatttttttttaaataaaatatatgtgtatttggagatgtaaatttatagtaagaatataagattattttaataagtattaaattgaggtttagggaagttaaataataaggttatggatatttggttaggtttagaaaagtttgtattttaagtttaaggtaaagaaaggttttattgttttgaagtttttagtatggtaaagttatatggttattagagagttaattaaaaaaattatgtttaaattatttttatgttttagagttttttatttttagatttagaatgtagtttaaagatgtgatttgagatatttttgtttttttttgagaggaaatgtatagttggaagtttataaaaatatttttttaaaaaatagtaatattgtttttatttttataaaaagtttttattataattttttggtggtattttatgtttttaagtatttattttggtgatcgttggtttttttttagtttgttttataagttaggttataaatggtttgaaattaggggttttgtttttattttgaatttatcgtagagtttggtatagcgtggtagagtgtgcgtttaataaatatttgagtggaattatattgaaaaataggaagaagtaaagttattttttatttgttaaagattgtgatgttgttgtattggtaatttttatttttagaaagttttaatgtgaatgaaattattttttattgtgtatttgaaaattttattgaaaatagttttaaaaattaagtatgtttttttagaggtagggggtatagttttggatagatgagaaaagtgatagtgatatttttgtattgtttagagaagaaaggttaataaagagtagaaatagaatatttaatttattttgtattttttttttagaatattttttgtgtgttttttattatttaagttttttatatgtagtttttttgaaattgattatatgtttttttggggtgaggggaggagacggaagaaggagatggagaaggtttgagatgatttttttcgatagtagcgtttatttaggtttttggggaggtcgggttacggggtttttttgtattagtggtttataacgttttgtttgcggtttataatcgtttttttaaaataatttttttttgggacggttttcggtttttttttgttatttttatttttatttcgtttttatttttatttttagaggttttaggtaaacgtttcggattttcggttaggttttagagtaaatagtacgtttggaggattataatcgattcgaggttaattcgattttttttttttgtcgtttttaattgatttttgaagtagtttttgttttttttttaaatggaaaatttatagatatatatataaataaaaattttaagtttttttttcggttttattcgtaatgacgttttttttttcgggtttcgtttttttagggggtttggaattttgggattggtcgagaggttgtggcgataaggttcggattggatagtatggcgttgattgatagcgggggcggtcgtcgcgtttttttttttttttcggtgtgtaaatgtgtgtgtgcggtgttatgtcggataagagggaggtgatcgtggcggcggcggcggcggttttgtttattgtttttttcggtgtgtgtgtgtgaggaaatcggggttgtagcgaggttaaggttgtttttgaagtagcggcggcgatcgggacgattattttggcgattcgagtggttggttttcgcggagtgtgagaaggataaggtatttttgcgttttcgttacgttcgagcgtttcgggttttatcgcggttttcgcggttcgtnatcgcgttttagttcggtttgtagcggcgtcgggcgggcgagaaggtaacgtcgtcgttgcgtcgtcgtcggtcgttttttgttttttttttagtcgtcgcgttaggttcgggcggcggacgtcgcgtttcgagtttgagggtagtcggcgcgcggtttttttagcgggttcggttggacgttcgtttcggattttcgcgatggggcgcgggggtcggcgcggttaggagttcggcgagtggagcggtgggtgcgaatcggcggggtttagcggttcgtagggaggcgggagcggcggttgcggttttagggtttgtgagttggaggtattcgttatggttaagtcgggtggttgcggcgcgggagtcggcgtgggcggcggtaacggggtattgatttgggtggtaagtggttggttttcgggacgggcggttgtattgtttcgggttcgcggcgggggcggaatttcgaacgggcgggggaggggaaagggagggaaatttcgtttttcgaacgggcgttttataggggtttgtgtttgtagaattttttagttcgtttttcgcgttttttttttttttttttttttgtacgtttttggaagttttgattgttagagcgtaatgtgtatttgaaattttggggggataaaatcgcgaacgtaatatatagttttcgtttttttttttttttttttaattagattttttcggggtagtcgaatttgaaatggtggggatggcgataatgtaagtgtgtttgtgtggggtagtattttttttaaatgtagtttaagaaaattttgggaaaaggggtgtgtgtgtgtgtgtattttaaatgtagttttttttggggttttaattttaaagaagaatgtattgggatttttatagtaatttgtattttaatttggaaagttttatttaatgcgtttaattgagagcgtattggggatgatttttatagtagttaatattgtaggtcgtttttttgttagggtgagattattaaaagaagtgtttgtttacgttagtatcgtaggtgtaacggggtgagggttgaatggatgttttggagaggtgattgaagtgtttagttttgaagttaaaggatttcgacgtttagtttttgttgggaagtagaagtaattgtagcggaaggaggaagggagattggatttttacgatagatcgataattcgtcggtattttatttgtttagcgtagagtttagattagggttattttttatatagaaaatttaggtatttcggagaaaagtaaaaagtgttatatttttttggatttttgacggtttgttttttcgtttttgttttaaatattttaagggagtttttatataggtatttttgttatttagttcgttttttttttgtttgggtga

SEQ ID NO: 172 - DNA, 6069 bp, Artificial Sequence
  chemically treated genomic DNA (Homo sapiens)
  unsure (1405)
ttatttaaataaagagaaaacgaattaagtaataaaaatgtttatatgaaagtttttttgaggtatttaaaatagggacgggggaatagatcgttaaaagtttagaaaaatgtaatattttttattttttttcgaaatatttaggttttttgtataggaaatgattttggtttgaattttacgttgagtaagtgaaatgtcggcgaattatcgatttgtcgtgggaatttagttttttttttttttttcgttgtagttatttttattttttagtaagaattgagcgtcgaaattttttaattttaggattaagtattttagttatttttttaggatatttatttagtttttatttcgttatatttgcgatgttgacgtagataagtattttttttaataattttattttgatagagggacgatttatagtattaattgttgtgaaagttatttttaatgcgtttttaattgagcgtattgaatgaggttttttaaattgaagtgtaagttgttgtagaaattttaatgtatttttttttgagattaaagttttagaaagagttgtatttagaatatatatatatatatatttttttttttagggtttttttgaattatatttggagaaaatgttgttttatatagatatatttgtattatcgttatttttattattttaggttcggttgtttcggaagagtttggttaaaaagaaaagagaggaagcgggggttgtatgttacgttcgcggttttgtttttttaaagttttaagtatatattacgttttggtagttaggatttttagagacgtatagagaaagaaagaaagaaaaggcgcggggagcgggttggaggattttgtaagtataggtttttatggagcgttcgttcgggggacgggattttttttttttttttttttttcgttcgttcggaatttcgttttcgtcgcgggttcggaataatgtagtcgttcgtttcggggattagttatttattatttaggttagtgtttcgttgtcgtcgtttacgtcggttttcgcgtcgtagttattcgatttggttatggcgagtgtttttagtttataggttttgaggtcgtagtcgtcgttttcgtttttttgcgggtcgttgggtttcgtcggttcgtatttatcgttttattcgtcggatttttagtcgcgtcgattttcgcgttttatcgcgaagattcggagcggacgtttagtcgagttcgttgaggaggtcgcgcgtcggttgtttttaaattcgaggcgcggcgttcgtcgttcgggtttagcgcggcggttgaggagaaagtagggagcgatcggcggcggcgtagcggcggcgttgttttttcgttcgttcggcgtcgttgtaggtcgggttgaagcgcgatngcgagtcgcgagggtcgcggtggagttcgaggcgttcggacgtggcgaggacgtagaggtgttttgttttttttatatttcgcgaaggttagttattcgagtcgttagagtagtcgtttcggtcgtcgtcgttgttttaaaggtagttttagtttcgttgtagtttcgatttttttatatatatatatcgagagggataataaatagagtcgtcgtcgtcgtcgttacggttattttttttttgttcggtataatatcgtatatatatatttgtatatcggggagagagggagggcgcggcggtcgttttcgttgttagttagcgttatgttgtttaattcgggttttgtcgttatagtttttcggttaattttaaaattttaagttttttggaggggcgggattcgaggggggaaacgttattgcgggtagaatcgaaaggaagatttggggtttttgtttgtgtgtgtgtttgtgggttttttatttgaagggagagtaggggttgttttaagggttaattgagggcggtaaagggaaagggtcgaattggtttcgggtcgattgtaattttttaagcgtgttgtttattttgagatttaatcgggaattcgaagcgtttgtttggggtttttaaggatgaggatgggggcggggtggggatgggggtggtaggaagaagtcgggggtcgttttaaagggaaattattttaaaagagcggttgtaaatcgtaggtaagacgttgtagattattggtgtaaggaggtttcgtgattcggtttttttaagggtttaagtggacgttgttgtcgaaaaaaattattttagattttttttatttttttttttcgttttttttttttattttaaaagagtatatggttagttttaagaaaattatatatgaaaagtttaaatgataagggatatatagagaatgttttagggaaagaatgtagggtgggttgagtgttttatttttattttttgttgattttttttttttgaataatgtagagatgttattgttattttttttatttgtttagaattgtgttttttgtttttaagagggtatgtttaatttttaaaattgtttttagtggaatttttaaatgtatagtaaggaataattttatttatattaaagttttttaagaatgaaaattattaatatagtaatattatagtttttggtagatggaagatggttttatttttttttgttttttagtgtaattttatttaagtatttattgggcgtatattttgttacgttgtgttaggttttgcgatgggtttaaagtaaaaataaggtttttgattttaaattatttataatttggtttgtgagatagattaaaagggagttaacgattattaaaatgagtatttgaaggtatgaagtgttattaaagagttgtgatgaaagttttttataaagatgaaaatagtattattgttttttgaagaggtgtttttgtgaatttttaattgtgtatttttttttaagggaaaataaaaatgttttaggttatatttttaaattgtattttgagtttagaggtggagaattttgaaatatggaaataatttaaatatagtttttttaattagttttttgatggttatgtaattttgttatattagggattttagaatagtgaagtttttttttattttgaatttggggtgtaaatttttttgaatttgattaagtatttatagttttgttatttaatttttttgagttttagtttagtgtttgttaaaatgattttgtgtttttattgtgagtttgtatttttaagtatatatgtattttgtttgaaaaggggtaattttaaaggtaatgagttttttttatgaagatgtattaggtagaagttaagttataaaatatatagttgtttttttttttaaatttaagttgttaaagttttttatttttcgtttttgttgttgtttttagagatagagttttgttttgttatttaggttggagtatagtggtatgatttcggtttattgtattttttattttttaggtttaagtaatttttttgttttagttttttaggtagttgggattataggtatcggttattatgtttggttaattttttttatttttattagagacggggtttttattatgttggttattttggtttcgaatttttgattttaagtgagtcgtttattttggttttttaaaatgttgggattataggtatgagttatcgtatttagtttaggtttagattttgaaatgaataaaataatatatttaaaatttaaatagattaataaaaataatgttttttttatttgttttatatgtgaggtattgagtttttttgtttttttagtatgaaaaagttttttaataagtgttattagttttaagaaaatattgatttatttagaagaattgtaaataagaattgttgaatatatatgaaaattaatatttttaaagtagagatttgtgatgagtggaagacggaatttagattaaaagtattttagtttttaaagaattgttttttttaattgtgtagtagatttagtatatttttatgataaaattgattgtacgtaatttgagtatagtttttttttttggggtaatgtgaagtaatttttaattaggggtggattatttgaggttaggagtttaagattagtttgacgaatattatgaaattttttttttattaaaaatataaaaattagttaggcgtggtgatttgtgtttataattttagttattggggaggtagatataggagaattatttgaatttgggaggtagaggttgtagtgagtcgagatcgtattattgtattttagttttagcgatagagcgagattttattttaaaaaaaaaaaaaaaaaagtttttatattaggtttgtttagttttagatattattttgtatgtatatattatatataatgatttaatttttattttatagtaagtattgattaaaaggaaaaattagaaattagttatttttataaattgtataaaggtttttatttaattaagatttttgagtagtttttataggagtttattttaattattttagaatttttatttttagattttatatttttttattgtagtaatgaaaaaaaaattaaatgtttattgtgttaggtatttaggatttgggaatttaaaaaggtgatgaagacgtattttttgttttaagtttatttttgaattatagttttaagttaattatttaattgaaaagtaattttatatttatttatttgttgtttaataaataatttatttcgttttgggagattaaggtaggtagattatttgaggttaggagtttaagattagttttgttaagatggtaaaatcgtatttttattaaaaatataaaaattagttgggtatgtgtttgtaattttagttattcgggaggttgaggtaggagaatcgtttgaattcggaaggcggaggttgtagtgtattaagattgtattattgtattttaattcgggtaatagagtaagattttattttaaaaatatatatatatataaaaaataaataatttatttgatgagttatatttattattatattttatatatagtaggtaatttaattagtaagtaaattatttaagaaaatagtaatttaaaattatatttttaggtatttgttaaagttttaatagtttttatttaaatgttgtgtattattttaatattgagatttagttgggaggaggaggataaatttttaatttcgggagtatttaaagaagttaatatttgaatttaaaatttaatgtttataattttatttttttttttttattgtattaattttgtggatttttacgatatataaggttgttggattaagaaaaatttttaatgtttggtttatggtagatttagtaagtgattgtttagttaatgattattgtatgtttaaatgtaatttagtttgttatagttttttagaagtgagtttaaggaagaaaagttattattaatgtgattttttggtttttagtatttttttagtaaatattatagtatattattaattttgttttttttaattatttaattgttatagtttataagtatatttttatttttaaaatgatatttaagtattaaaagtaataagtgtttgcggatggttgaagatattaatgattatatttttgagtattattattattaggaagatagatagtaggtaaagttttttaatttttatttgtaataattatagggtatagtatttgttttgattttttgttttgtaggagtttgtttagattggttttggttaaataagttatattgattttttggtgatattttaattatatagatagaagggatatttttatttatatgatatagtttaataatatttagggtttttagtaatttagggtttttaataataatttagggtttttatataacgtggagaataaaattagtatgtgttttaagaaagttgtttttggtttttgtaaaaatgtttaataattggatggatttttaaagatgtattttgttttgagaaaattttgttttgggggatattagatgttattatgtatttgttttttattaataagatatataatttattatgtgt

SEQ ID NO: 173 - DNA, 6078 bp, Artificial Sequence
  chemically treated genomic DNA (Homo sapiens)
ataagtaagggtttggtgtggttgtttatatttgtaattttagtattttgggaggtcgaggtaggcgaattatttgagtttaggagttcgagattagtttggttaaaatggtaaaattttatttttattaaaaatataaaagttagttaggtatggtggggggtatttgtaattttagttatttaggaggttgaggtaggagaattgtttgaatttaggaggtagaggttatagtgagtcgatattgtgttattgtattttagtttgggtaatagagcgagatttcgttttaaaaaaaaaaaaaaaattaaaaaataaaatttatagaatgtttaatattaagagtgaattttgggtgataatgatgtattagtataggtttattaattgtaataatttatattattttggtgtgggatattgatagtgtgggatgtatgtgtgatatgggtattgtattttttgttaaattttgtcgtgaatttaaaattgttttgaaattaaagtttgtttagaaggaaaaatagttgagtatattatgtgtagaatattttaagatttggaatgggatatttaagggtagatttttgagattaagaatgaaatagaattggtatgaattgaagtttagttttgagaattttggtaggtagaaaattttagtttttaaaattggattaaggtgattttgggtttttagtgttttaggataaaatttttttttgaaggaagaaaatattgttattatagattattttagtaaagttttaaatatagtgtttagtacgtaattaaagataatgaggagataatgtgaatgagaattaaaaaaagtaagtgtttttaggggttttagaatgattagaaataggatttaaaataattatgttaattattgttaaggtatatagagaatgttaattgagaatttgaattgttaataaggatatagtaaatttgaaaaagattaatagaaattgtaggattgaaaaattataatatagattaagaattatatgggtcgggcgtggtggtttaagtttgtaattttaggattttgggaggtcgaggcgggtggattacgaggttaggagtttaagattagtttggttaatatggtgaaatttcgtttttattaaaaatataaaaaaataattagttaggtgtggtggtacgtgtttgtagttttagttatttagggaggttgaggtagagaattgtttgaatttgggaggtggaggttgtagtgagtcgagattgtgtcgttgtattttagttagggcgatagagcgagaatttgttttaaaaaaaaaaaaaaaagaattattgttgttttagtttattttagtttatttttcgatttttaatttagatgttatttatgtatttattttggaagttttttttgattaatttgtttggatgtaggtttttttaataattttttttatttattattagtagttttttttaaggttattgtatttttttttaatgtaatggttttattgagataattagtttatattgtttatttttttaaaatatataatttttagtatatttatatagttgtgtaattattattaattaattttagagtatttttattatttttaaaaggaattttgtatttattagtagttattttttattttttttttaattttttagttttagtaggaggttggagtagtagtttattaatgttgttttgaatattagtgtatatgtttttgttatatgttttatttttatttttagaaatagagtgtattagtttgtttttatattgttgtaaagagttgttttagattgggtaatttatgaagaaaagaggtttaattgatttataggtttgtaggtttaatcggaagtatgattggaagtttttaggaaatttataattatggattaaggtaaaggggaagttattattttttttatacgagagtaggagaaaaagattgtgaagcggaaagtattacgtatttttaagtaattagatttcgtgagaagttatttattatattgagaatagtaaggggaaaatttgtttttattatttatttattttttaagttttttttttaatattgggaataataattggatatgagatttgagtggggatatagagttaaattatattatagggttttattatgttgtttaggttagaatgtaattatagtttattgtaattttgaatttttggttttaaggtatttttttgttttggttttttaaagtgttgggattataggtatgtgttattgagtttggaatggatatatgtttttaattttttcgggtatatatttaggagtgaaatttttgggttttatggtgattttatgttttataattttgggaattgatagatagttttttaaaattttttttttttgagatagggttttgttgtgttgtttaggttatatagtgtattggtttataggtttgattatagtatagtatattgaggtttttatttcgtggttttaagggatttttttgttttagttttttaagtagttaggattataggttagtgttattatgtttagtttaaagtattttatatttttattaatagggtataagggttttaatttttttatagttttgttaatatttgttattttttgtttttttgaatatagtttttttagtgggtataaagtggtatttttttgttttttttttttttttttttttgagattgagtttcgttttgttatttagtaataagttggagtgtaatggtgtgattttagtttattgtagtttttttcgttttttaggtttaagcgatttttttgttttagtttttcgagtaattgggattataggtttgagttattaagtttggttagtttttgtatttttagtagagatggggttttattatattggttagtttggtttttaatttttgattttaagtgatttgttcgttttggttttttaaagtgttgggattataggtgtgaagtattacgtttgattgttttttttttttgagataaggttttattttgttgtttaggttggagtggagtgggatgattttggtatattgtaatatgttgtttaggttggttttgaatttttgggtttaagagatttgtttatttgggttttttaaagtgttgggattataggtgtgagttacggtgttcggtttttttgtgtgtgtgttttttggtttttttttttgagatggtgattaaaaaaatataataataaataataaataaaaaataaaacgaagttatttttttgtatgtgaatgtttagtagtggtagtattaattgttgaaaagattgtttttttattattgatttgttttggtgtttttgttgatgtaaatgtgagggttattgatttattttaggatttttaattttatttgtttatatttttattttttatgagtatgttcgtagggttattgtgtatgttagtagggttattgtgttttatagaagaaatttaagaagaattatttttttttttttttttattaaaagttatgtttattaatttagtattataattcgttttagaattttttatgtagttggaaagggaatatgggaagaggtgagtatgttggaaatgtagggtagtttttaaattgaggttttattttgtttgttttaaagttaaaaatatagggtttagtaaagaggagtttagaggttggagatgaaaataaaagtttttggtttagatggtaaaggaggtttttaagagtagtagaattagtatatttcgaaggtagtgttggaggtatttttatgaagtagggggtttttttttggtatttaagttttttttaatttttttaagttttttagttaggtttggtatgttatagttttgagttagatatattttaattacgttgtttaatgtaaatttaagtaggaattggagtatgatgttggtggggagggcgaggagggcgtaaagggttgttgtagttttgtaggtcggttagagtttgtttttttatgcgaggggagcggaatcgtttttttcgttatttttttttttttgagagggagttttatttttgtcgtttaggttgtagtgtaatggcgcggatttcggtttattgtaattttcgtttttcgggtttaagcgattttttagttttagtttttttagtagttgggattataggcgttagttattacgttcggttaatttttgttatttttagtagagacgtggttttatcgtgttggttaggttggtttcgaatttttgattttaggtgattcgttcgtttcggttttttaaagtgttgggattataggcgtgagttatagcgttttgttaagaagaattattttttaattttaatttaaagtaattaatttaagggttggaattatttattttttatttagaatttttagtagcggtttttagtattagtagtcgttaagattgtgttgggtcgttgtttttttgttgttttaaattacggttatgtgtttggtaagggtgttggttaatcgaaaatgttggttttagagttagaagtattggtatttaaataaatatatttgggggttgggggttgatgagtaaggttgggaggagataaaagaagtatttcggtttagtcgttagagacgcgtaaggtgtaacggagagagtaatttaggttgtgagagtggttttaaatattgagatatggagttaggatttttgtttttgggggatggttttagtattgatgcgtaggatttggtttttgaaggagttgataaaattgtcgtttattcgcgcgattatcggtaaagtagttttatagtttgtttttttttttggttgtttttttatttatttttcgttttgttttttttttttttttttttttttttttttttgcgcgaagcggaagtgacgcgaggcgtagcggaagttattgtagtcgcggtgttgtgttgtggggaagggagaaggatttgtaaatttcggagcgaggttttgtttattcgaggtcgttgttgtgcggagattttcgggtgaagttatcgttattatgtttgattaggtatcgggttgggagttatttaacggcggtggttagcggtttttttgtaggtttgtttgtcgttatggggttcggggatggaggcgcgggggaggggattcggaatgggggagggggcggtcggtggggattaggtaggcgacgtatacgatcgattacgtcggtagtgtcggggtttgttgcggggttttcgagcgttcgttttttttcgggttcgtttattattttcgtattttatcgtttttggtggcgttttttttatgtcgttttatttttttttttcgggtcgattaggtgtagagcgtcgtttttatttttttgggagggtttttggagaattcgttcgtttttttttagaggattaatcgtagaagtagggttttaggttttagttatgtaacgggagagaatttttgattgggaggtttcgtggttttgagaagcggttggattttttattttttgttttttcgtcgggagggcgtggggcggcgagggagggagacgttcgatgttgttgggaattttgttttcgttcggattggagttagggtaaggatgtcgttgtttttttttgagttttttttcgtgtgggggtgtagagttgtcgtttttttattgtattttttcgttttttattcgggattggtttattttagttttttagttgtaagagagtatttataataattaagaaagaaaatagaattaaattgttagagtaataaaaagtattttatttgggtattaatttgaggaagttttatatttttgaggaaaagtataggaaaattttgtgtatgtagagtcgttgtagaatatttgtagaaagttgtttggtaaggtaaagtgttttagtttattgttagtattaataatttatttgggatttgtatttaattaggagtgatcgattttttttttttttttttattttgttttaattaaataattttatggttagtttttaatttataaagtttttgtttggttttttgtt

SEQ ID NO: 174 - DNA, 6078 bp, Artificial Sequence
  chemically treated genomic DNA (Homo sapiens)
aataaaagattagataaaaattttatgaattaaaaattagttataaagttgtttaattagaataggatgaggaagaaaaggggaaatcgattatttttgattaagtgtaaattttaagtaaattattgatattaatagtgagttggagtattttgttttattaggtaattttttgtaaatattttgtaacgattttatatatataaagtttttttatgtttttttttaaaaatatgagatttttttaggttaatgtttaggtgagatgttttttgttgttttagtagtttagttttatttttttttttggttattatgaatgtttttttataattggagagttaggatgaattaatttcgagtaagaaacgggaaagtatagtaaagaggcgatagttttgtatttttatacggaaaaagatttagaggagagtagcggtatttttgttttagttttaattcgaacggaggtaggatttttaataatatcggacgtttttttttttcgtcgttttacgttttttcgacgaagaagtaaaaagtggagagtttagtcgttttttagggttacggagttttttagttagggattttttttcgttatataattaaggtttagggttttgtttttgcgattagttttttggaaggagacggacgggttttttagagatttttttagggaggtggaagcggcgttttgtatttagtcgattcgggagaaagaagtgggacgatatgagggaggcgttattaaaggcggtggggtacgggggtgatgagcgagttcggagaggggcgggcgttcgggagtttcgtagtaggtttcggtattgtcggcgtagtcggtcgtgtgcgtcgtttgtttagtttttatcggtcgtttttttttttatttcgggttttttttttcgcgtttttattttcgagttttatagcggtaggtagatttgtagggaagtcgttggttatcgtcgttggatggtttttagttcggtatttggttagatatgatgacggtggttttattcgggggttttcgtatagtagcggtttcgggtaagtagaatttcgtttcggggtttataaattttttttttttttttatagtataatatcgcggttgtagtaattttcgttacgtttcgcgttattttcgtttcgcgtagggaggagggagagagagaagagaggaaagataaggcgggaaatgggtgggggagtagttaaggggaggggtaggttgtggagttgttttgtcggtggtcgcgcgggtgaacggtagttttgttagtttttttaaggattaggttttgcgtattagtattagggttattttttaggagtaaaggttttggttttatgttttaatgtttggagttatttttataatttagattgtttttttcgttatattttgcgcgtttttgacgattgagtcgagatattttttttgtttttttttagttttgtttattaatttttaatttttaaatatgtttatttgaatgttagtatttttagttttagaattaatattttcggttaattagtatttttgttaaatatatgatcgtgatttaaaataataagaaagtaacgatttaatataattttgacggttattgatgttaaagatcgttgttgaaagttttaaatggggagtgagtaattttaatttttgaattggttgttttgagttaaggttaaagaatgattttttttggtagggcgttgtggtttacgtttataattttagtattttgggaggtcgaggcgggcggattatttgagattaggagttcgagattagtttggttaatacggtgaaattacgtttttattaaaaataataaaaattagtcgggcgtggtggttggcgtttataattttagttattagggaggttgaggttggagaatcgtttgaattcgggaggcggaggttgtagtgagtcgagattcgcgttattgtattgtagtttgggcgataagagtgaaatttttttttaaaaaaaaaaaggtggcggggggggcgatttcgtttttttcgtatggggaagtaggttttgatcggtttgtagagttgtagtagttttttgcgtttttttcgttttttttattaatattatgttttaatttttgtttggatttatattgggtaacgtggttggaatgtatttggtttagaattatgatatattaaatttggttaaaaaatttgaagaaattaaaaaggatttggatgttaagaagaaattttttattttatgagaatgtttttagtattgttttcgggatatattgattttattgtttttgagggttttttttattatttgaattaaaagtttttgtttttatttttagtttttgggtttttttttgttagattttgtgtttttggttttagagtaagtaaaatggggttttaatttgagaattattttatatttttaatatatttatttttttttatattttttttttaattgtatgggaggttttaagacgaattgtggtgttagattagtaaatatgatttttaatggaaaaaaaaaaaagaatgattttttttagattttttttgtaaaatataatggttttattggtatatatagtggttttacgggtatatttatggaggataagaatataaataaatagaattgagaattttgaaataaattaataatttttatatttatattaataaaaatattaagataaattaatggtgaaagaatagtttttttaatagttggtattattattgttggatatttatatgtaaaagaatgatttcgttttgttttttgtttgttgtttgttgttgtgtttttttggttattattttaaaaaaaaaaattaaaaaatatatatataaggaggtcgggtatcgtggtttatatttgtaattttagtattttgggaggtttaggtgggtagattttttgagtttaggagtttaagattagtttgggtaatatgttgtagtgtgttaagattattttattttattttagtttgggtaatagagtaagattttgttttaaaaaaaaaaaataattaggcgtggtgttttatatttgtaattttagtattttgggaggttaagacgggtagattatttgagattaggagttggagattaggttggttaatatggtgaaattttatttttattaaaaatgtaaaagttagttaggtttggtggtttaggtttgtaattttagttattcgggagattgaggtaggagaatcgtttgaatttgggaagcggaggaggttgtagtgagttgagattatattattgtattttagtttgttattgggtgatagagcgagatttagttttaaaaaaaaaaaaaaaaaaaaaataaggagatattattttatatttattagaagggttatgtttaaaaagatagaaaataataagtgttgataaggttatggagaaattagaatttttatattttgttagtaggaatataaaatgttttaggttaggtatggtggtattggtttatagttttagttatttgggaggttgaggtagaaggattttttgaggttacgaggtggaagttttagtgtgttatgttatgattaagtttgtgagttaatgtattatatagtttggataatatagtaagattttgttttaaaaaaaaaaagttttgaaaaattgtttgttagtttttaaaattgtaaaatataaagttattataagatttagaaattttatttttaggtatatattcgagagaattgaaaatatatatttattttagatttagtggtatatgtttataattttagtattttgggaggttaaggtaggaggatattttgaggttaagagtttaagattatagtgagttatgattgtattttagtttgggtagtatagtgagattttgtgatatggtttggttttgtgtttttatttaaattttatgtttagttgttatttttagtgttgggggagggatttgggaggtgagtgaataatggggatagattttttttttgttgtttttaatatagtgagtgattttttacgagatttggttgtttaaaagtgcgtagtatttttcgttttatagttttttttttttgttttcgtgtgaagaaggtgatagttttttttttgttttggtttatgattgtaagttttttgagggtttttagttatgttttcggttaggtttgtagatttatgagttaattaaattttttttttttatgaattatttagtttaaggtagttttttatagtaatgtgagaatagattaatatattttgtttttaaaaataaaaataaaatatataataaaaatatgtatattaatgtttaaagtaatattagtgagttattgttttagttttttattagggttgagggattagggagaaaatggagagtgattgttgatgggtatagagttttttttggaagtgatgaaaatgttttaaaattgattggtgatggttgtatagttatatgaatatattaaaaattatatattttaaagaggtgagtagtataagttaattattttagtaaaattattatattaaaaaaaaatataatggttttgaaaagagttgttagtaataggtgaagaggattattaagggagtttatatttaagtaagttagttaggaaaagtttttaaaataaatatataaataatatttaaattgaaggtcggagagtaagttgaaataagttagagtagtagtagtttttttttttttttttttgagataaattttcgttttgtcgttttggttggagtgtagcggtataatttcggtttattgtaatttttattttttaagtttaagtaattttttgttttagtttttttgagtagttgggattataggtacgtgttattatatttggttaattatttttttgtatttttagtagaggcggggttttattatgttggttaggttggttttgaatttttgatttcgtgatttattcgtttcggttttttaaagttttgggattataggtttgagttattacgttcggtttatataatttttaatttgtattatagttttttagttttataatttttattggttttttttaaatttgttatgtttttgttaataatttaaatttttagttgatattttttatatattttaataataattaatatggttattttagattttgtttttgattattttagagtttttggaggtatttgttttttttgatttttatttatattatttttttattatttttgattacgtgttgggtattgtgtttgaaattttgttgaaataatttgtaataataatattttttttttttagagaggagttttgttttagggtattaggaatttagagttattttaatttaattttagggattgagattttttatttgttagaatttttaaagttgggttttaatttatgttagttttgttttatttttagttttaagagtttatttttagatgttttattttaaattttggggtgttttatatatgatatatttaattgtttttttttttaaatagattttgattttagagtagttttaggtttacgataaaatttagtaggaagtatagtgtttatattatatatgtattttatattattaatgttttatattagaataatataaattattataattgataaatttatgttgatgtattattattatttaaagtttatttttggtgttagatattttatgggttttattttttaattttttttttttttttgagacggagtttcgttttgttgtttaggttggagtgtagtggtataatgtcggtttattgtaatttttgttttttgggtttaagtaatttttttgttttagttttttgagtagttgggattataggtgttttttattatgtttggttaatttttgtatttttagtagagatagggttttattattttggttaggttggtttcgaatttttgggtttaagtgattcgtttgtttcggttttttaaagtgttgggattataggtgtgagtaattatattaggtttttatttat

SEQ ID NO: 175 - DNA, 11523 bp, Artificial Sequence
  chemically treated genomic DNA (Homo sapiens)
attgtttaagacggaaagattttaagattgtgtgattttttttttttttttttttttttttttttttttataggtgtagaataattttttttttttttttcgtggttttttttttttttattttttttttttgttgtttgtaaagttgaatttggggttaggagttttaattgtaattttagattggaattttagatggtgcgtttaggattggaagtaatttttagtttattaattttatgggtttacgtatttgttttggttacggtttggtttttatttttattgtggtattaatgtagaataaattgagatatattttttatataattagttttagaatttaaaaagatttacggtataataatagaggtagtgtcgcggaatttttttattgaggattttcggggagttcggggattatttcgcggtggtattagaatagacgagtaattttagcggttttaggtattgcgaattgggggagagggggaaattttgtatcgtattcggtagtatttaacggtttcgggtttttagatagggttagcgaggagagttaggatagtaagtggggattggttaaaaaaaatcgatttaattttgaaatgattagaagaagttgggagtagttattataaagttttttttttgtttttttttttttttaattgaaggaatgacgttgaaatttttatcgttagcgcggggttgggaattattttaaatatttgttttgtagtttcgagtgggtagatttcgaagagttggagtcggcggggaggggaggaatagttgttgggttgttttgcgcgtggggttcggggcgcgggtttcggggagaggcgttagtcgaaagtttgtttttttttcgcgataggtagtagcgaggtcgagttattttttattacggtttgcgggtttcgcgcgtagtgtggttgttttcgtttttgatcgatcgtagcgttttggggtgtttatttagttgttcgcggtcgttgggtgattttcggagggcggtttaggcgtgcgtattggtttttggggttgcggttgtagtagtttagtttcgcgttttgttagatgtagtggatagcgtcggggtgaaagtaagggttgagaaatttttattgttttgtttttatttagtttcgatttttttatattgtaataattatgtattttcgaggtcgggatgtttgcgttttgttagtgtattaacgttatatggttttttaggggttgttttcgtttttgtattttattagttttgaagaggtagaggggtggtgggtaaaatttttaattggacgttgagagattcgggttttagttcggcgttgttattaatttgttttttgtttttaaatagtagtagtaataaaaattgtaaagttgattgagttaaaggtttatattgtttttttatttaatttttagaataattttatgaggtgggcgttagtattttattatttcgtttgattagtaaggaaattgaggtttagagagattgcggaattcgtttagggttatatagttgttggttatttggtagagttgaggttttattttggggttattaattttttgttttttatcgttgcgttttatagattgtttttttttcggttgtttgggttttagtttttttttttgtaaaacgagaagtttaatttgtagttttttttgttaatcggtggtttagattaggaatttttgttatagatttcggcgttgataggggtaagaaggtgggtgaaagaagggggcgtttagttttttatagtttgtttttttttgggatttcgcgaagggcgggtttcgcgagttaaaggaggtataggagagcgtttatcgttcgcggcgggtgaaggtgttatttgttttcgtgttaggttgtgagttttggtgtttagtttagggcgttaaggttagtgtagttggtatgttttttttggaaaattttaggtttttcgtagagaacgttatttataataaagaagaggatagagaggtatggagcgttttgcgattgtaggagtacgttagttttttagcgttggtttagtgtcgtttgggttttcgggtatgtggattcgttggggtcgtacggagattttttgtcgggtttttggggtttttcgattgcggttttttagtttagtattttttttttggtttcgtaggttgtagggaattttttttatttttttagtcggagaagtttaagtcgggcgagggggtatttcggggttcgtatcggtgtttttttttttttcgtttttataaggattttgagaaaataaatggtagaggagagaggagttttatatttgtttggtttttttttttttttatttatttttatattttttatttcggggtaaaaatttatttttgaaaaatgttggtagagatttacgtgtttttgttttatttgggttttataaatataacgatttatatttaagttagtttttttttagataatttttttttttttcgttaaaagtgttaaggatggtaaaagaagaaataattttaattttttcgtttggaaatgaaagttttcggttttttataaagggtttttcgttttttatagttgagttttagttaagaaaaacgatttttaagtagaaataataggcggggagaaggaagggagatatagggatttggggggtttttagggtaattggtagtgaattttgtttcgagagttttttttttatttaaaaaattaaacgcgcgagtttcgcgaaaggtttagggatagatcgtgtgggagaggattgagtagagagcgtgggggtagtgttttgtagaatttttttttttttaataataattttaaaagtttttgagtggagacgacgtaaagttaagtagtaaaggtggtttgggaggtaagcggagggtttaagtgtcgtatttttatttttagggttttttgcgtttacgggatgcgtatttttaagaagtgcgtttttcgagtaagttttgggttcgtatatatttcgggttcgtagttagaatttaatggcgataacgtttatgtaatgtaagttaaaaattaaagcgtaaaaaattattatgttatttattgaaacgttattttttgttaaattgtaattattttgttttatataagtttggttggaaagtttgtagttttagttcgggttagttaggtataggaggtcggattgtaatcggttgtttttttttcgtcgcgtttggtcgttttacgttgcgtcgtcgttgttgttttttggcgtttttgggattttatacgtatttttgaaatacgtttcgtttcggttttcggtttttttttttgtttaggggttgttttttaatagatattgatttttttagaagatttaaaaattaaattaaaatattttttattcgttttaaatatttgttttggggcgcgggggttgttaaatagagattagacgaagggagttagatttagcgaagtttttcgagtttttaaagattcgaatattaattcgcgttcgtgggtcgatggaggttttttttattttattttttggtttttttaattggttttcgttttttggttaattattgagtaattagaatggtattttcgattagggttataggtagtgttcggcggagtggttttaggagttattcgttttttgtcgggtttcgtatttaaatttttttttttattttttttttttaaattgggcgttaggatgtttcggtcggaatatacgtaggttttgggcgtttgtttaagggttttttttttttttaaattagtcgttgttttttcggtttaatcgtagaagaattagatattttttattggaaagggaaattaagtgttgttgattttaattttaggtaggcggtaatcgtttttcgtttggcgtaaattttattaagtaaataattattagtcgatcgaaatacgttcggtttataattggtgtaattttcggttatttaattgagggacgttcgtttttagtttcgatttttggaatttataaagggttatttttttttttagtgattttaagattatggttatttttttattcgatagttttagaagtaagagttagatttaagggtgtaaagtaagggtatacgtttttttgaagtttgattgagttttttttgcgtttttttgaagttttcgtttttttggagtttatttgtttttttttttaaattatttttttagattaataattttatttttatttttatcgtattcgattttgttcggatttattgtttatttgaacggattttttagtgagacgaggtttttatattggcgaaggttaagaaggggaggtggggggagggttgtgttatatcggttagttgagagcgcgtgttgggttgaagaggagggtgttttcgagagggacgttttttcggattcgtttttattttagttgcgagggcgtttttaaggagtagcgcgcgttgtttggtcgggtttgggttgttgagtgaatggagcggtcgagttttttggttttttttttttttcgcgtcgtcggttttttttatttgagttttgggaagttgagggtagttaggtagttggggtaaggagtttaaggtagcgtttatattcgggggtttttcgtaattcgatcgtttgttcgtttttttatttttcgtttttttttttatttatttatttatttatttatttatttagagtcgggacggtagtttaggcgttcgggtttcgtcgttttttcgtcgcgattttggatttttttttgttgtaggattcggtttttacgtgtgtttcggagtcggcgttttagtatacgtttcgtttcgggtttgggtgtttatagtagttagagtagtagggagttcgggattcgggcggtatttgggttaagttaggcgtcgtcgaggttagcgttgaacgtttttagggtcggaggagtcgcggggcgttcgggtttgagtcgtagtaaatgggtttcgacgtgcgggatttgaacgcgttgttgttcgtcgttttttttttgggtggcggcggcggttgtgttttgtttgtgagcggcgcggcgtagtgggcgtcggtgttggattttgcgttttcgggcgtttcggtttacgggtcgttgggcggtttcgcgtcgttatcggtttcgtcgttattttcgtcgtcgtcgttttatttttttattaaataggagtcgagttggggcggcgcggagtcgtacgaggagtagtgtttgagcgtttttattgtttattttttcggttagtttattggtatagtcggagtttgtcgttacgggtttttcggttttttttcgtttagttaggcgttattcggttaggttaggatgttttttaacgcgttttatttgtttagttgtttcgagagttagttcgttattcgtaattagggtaagtaggtcggggagcgttttttacgcgcggggtagtggcgttagggatttttcgttttaggatattttttttttttattttttttgatcgtagtttttatttagttgttttttaagggtcgtgaggatagcggaagcggcggttggggaggaggtcggagagtgggagtgtacgtaggtattggttttcgatattttttaaagttaggtagagttaggagtttgattgttcgtaagagtcgggagggcgtttggggttttttagagttcgagagatttcgggattgttagtttttacgggagtggaattaggagatcggcgtagtgtttggttttgttttggggagagttttgttaattaaggaaacgttaaattgttattaagcgtagcgttttttagacgtttggattttggattcggagtgggattagcgcgggggtgagcgtttgtgttgtgttgttttcgtagcgttaaaatgtttaggagtatttttagtttttataatacggtgttggtatatatttaggtgtatattaagtatcgtagagaattagaatgagtatatgtatttttagtaattaaatggttttttggaatagcgtcgtgttcgtggatagttttcgcgtatggtaatatagaagtggatttttattgggtttcgtttaggcggcggttacgtaggttttggggatggaagagaatttgatttattcgagtttaagttatgcgggattaggttttatcgtaggtagtggaaggaggtacgagttttggttttttttttagcgtatttggggcgtttttttattttgtaaacgcggggtttagttgggatagtatttttttaagatttggggttagaataaggatagggttattcgttgtgtttagttaggatataaggagggaattcggtatacgataagtattaggttggttttttatttcgcgtcgatgttcgtttatttttttttcgtttgggcggcgcggattcgaatttgcggagtttttgtagtttgttttttttatttatttttagtggatttttacgttattgagaatttaagttagttcggtttgattcggtaatttagtaaacgttttattaatataatggcggatgttttttttggagtaaaattattcgagggtttagggatcgggatgtttttggaatgcgtgggaagtagagtgtattttttgtaggaggtattttcgtttaaggttcgggagaagggttttgtttttgttgttcgtttttattcgcgttttttaaacgcgcgtttttaggtcgtttttattttagtttaattaggagtattcggttttcgcgaagttttggagaaatcgaaatcgttttttttttcgggagaatttgggattattgttttgtggaggaatcgtaagtagatttaagggttgtttttattttatgtttttagttagtgaaattagtgttttgtatttaaggggcgttgggataatttattggtcgttgaggtttgtgttttttgattagatcgcgttatttttgtttagtaggttggtgttatttttggggagtttttaggttttagtgttttcgtttataagaggatagttgagatgggtaatttggagattgggttcggtttgaagttatattttatagatgtagaagcgttatttattatttttttggggttttaaatatggaattcggtaatttatttaaatatttgtgattgagaaataatgaattcgagagtattgtttgtatgtgtgttatttggaggcggttgagaaattatcgaatttatgtttttggggtataaaatattattacgttattatttttttagtatttttaggggatttttgaaatttgggttttgtcgtttcgtttgggttttttgtttagttttttttagggtaggtttggtgtttgggattttattatatgtcgtggggggtgggattgtgggttttgtagttagtaggtattatatttttggaaaatatttggatttttttgtaatatataggcgtggttgttatggagaaaaagttaaaaggggattaggattagtaggtgaatgtattttttttttttattttggagaaaaagtttaatggagagagggttttagatttaagttatatagtttggaagtattatttttaggtttaagttttgttttgtagtgaaaatagatgggtttattttatttagtttttgaggtttattgggtagtttggatgtgagaagcgtttcggttgttattttggagtgggtaagggtggttttcgagattttgggtttattttttggatttttagggtttttgttgtttttttaggaatgtagggtttggtttaagatttgggttgtgagaggtaagggtattaatttttaaaaatgtggaaatggttattagagcgttaaggttaaattttaggggagaggaattaaggtcgtttttggatttttagggtagtttagttatggtgtataggtaggggtaattgttggtatttatttataatcgtttaaaattttataagtatgtttatattttaaatttttaaatattatattttgtattttaattttgtaaatattaatttagtaaatattaatcgtttatttggttaggtattgggttttgaatattaattaagataatggtttcgagaatttttgtaagaagtttattagttaattttggagaggttttttgttttggatgaggaaatttaggttttatgagattaggtggtagaggtgggatttgaatttagattatgttagggtgtttttattttttttttagggattttggttttatcgttgagatggattttttttggtttgcgggaggggtattaaatttttagtttatgtgtgggggttgacgggtttgtgagggtagatgtggggtgaggatttgagtagttttagattagatgtaaggtttaaggaggaggggaaaaaagtttgtttgggtcggacgcggtggttcgaggcggttggattatttgaggttaggagtttgagattagtttggttaatacggtgaaattttgtttttattgaaaatataaaaaaaaaaattggtcgggtttggtgacgggcgtttataattttagttattcgggaggttgaggtataagaatcgtttgaattcgggaggttgaggttgaagtgagttgagatcgcgttattgtattgtagtttgggcgatagagcgaaatttcgtttcggaaaaaaaaaaaaaaaaaagaggttgtttgttagtttattgatttcgtagtttcgtaggttcgtagaattttaaggtatgattaggtttgggattattaggttattttagggttaggtgcggaggtttgcgacgttcgagggttaaaggttttttttttcggttatataggagagggtattttgttgggggataggttttttttaattatagtgtagttgtagttatcgtttttagttttttgagtatttttttggttgagtttgttgtttattttattttttagtttttacggttcggttaggttaggcggttttcggtttttttgtagtcgtcggcgggggaggagggtatagagcgcgtttcgttttttagcgtacggttaaggttgcgtttttttttcgggtcgggattaatcgtgggaaaggcgttattttggttattcgattttttttttttaaggtttgtataaggagtttttgaatacgttgttttttttagtcggtagttttattttttttggtttttgttttcgtatttttcgcgttaggttaagcgttgggtttagggatagcgcgttttaattaaattcgtgttcgataagtttttaattaaaagagattttttttcgtttcgtaggcgtttttattattgtttttttcggggggatttgaaggagagggtttgaggtcggtttttgttcgtcgaggtttgcgtgttcggtttgggaggaggtttaggagggttcgcgggttacgggtatttttgggttcgagttttggggtgcggacggacgtttcgagagtgggtgtcgcgattcgggatttacggttttcgtcgggtacggatagttgcggagtagggttttgaggattgtgtagtgttttgggtttttgtttatttttgggtttaggaatggagaagggttcgtttagagaaaattttttcgtagtttttatttcgtttttttttttttttttttttttttttttttttttttttttttttttttttttttttttgtgtttgtttttttttttttttttttttttttagtgtttttttagaaattcggtttttatttcgggtaatagtgggtgttttgagttaaatttcgtttgtaagtttatttataggttttaaagaaggttaggttttaggttttaaaaggaagtttgtggaagtttaaacgtgttcgtttatgtaggagagttaacggggtcgggggttatttttgtttatttagtaggagagaaatggaggttttcgaggttatatgataaaagttagtggttttttaaatttttagtgtgtggtgttgagtagtgtgtgagatttaagtttggatttgtattattcgggagttaggatttgtttttttttttttttttttgtattttgttatattattttttaggtttatgtttttgttgttttagagaagttttttttttttttttttttttttttttttttttgggcggggggtggtggtgtgtgtgtatgagcgttcgtgtgtgtttcgaaaatggaggtaacgatgttttgggttttgtttatcggttgagttttgtttaagtttttggaggtattttggttaaatagtgtaagagtgggagaatgggtgttgtttgatttaatttatttttgagaattttgtgaagtttggagatttagggtagttttgggttaggaggatttgaggttgttggggtggttttgttaggattttataggagtagttttttttagttattgtgtttggattttaggttatagatttcggaatttgtagaggaatgagattttatttttgggtttcggggttaatgacgtatttttagtcgaaggatttttttttttagaggtagtaatagttttttagaagtttgtggggtataagtttaaagtaatttaataataaaaattataaaagattatgttttttaattgaggttttacgtttttttttttattttgggggggggggggaatgttaggatttttttagggggaaattgaggtaaaggatcgaagtattattatggagggaaagggagatatagtgttaggtatattttaaaggaaattggttgtttagtttggggagtgaggaagttggtttttatagtagtggttagggtcggatttttgggcgtaaggtgggttttataggggggaggaggaggagagcgtagggtcgttatttgaaggtttaattggaaggggtttttgtttttttttttattagtttttttttgggtgttatggtgttaggtcgggtagttttagatagataatattattcggtaattattttttttatttttaagattaggttatttaattggtttcgagtaattaatgaaagttggtgcgcgggtttttgatttatagttcggagttaacgcggggttagtttagtagatttatttcgtttgttcgcgttgtttttgcggaagagttgtagtttatttttggggggtgaataattttttttgtcgattaggtaacgagttttatatttaatttgttaggggttcgttgtagaagcggtagagatcgtagaagattgcggtataaataaattgggaaaaagcgaggtgggggttttagttagaaaaggatggagaagtttgttttaaggttatatttagggatttgggtcgtttttttgtcgaaagttttggaggtttgtggggttggattttttttcgttgggggttcgaatgcggggtttagcgtatatttttttcgttcgtggttggtttagatttattgtttcgttttgcgagagtatcgttgatattgtgttttttttcgtcgttttcgtagg

SEQ ID NO: 176 - DNA, 11523 bp, Artificial Sequence
  chemically treated genomic DNA (Homo sapiens)
tttgcgggagcggcggagagaagtatagtgttagcggtgttttcgtaagacggggtagtgggtttgaattagttacgggcggggggggtgtgcgttgaatttcgtattcggatttttagcggaggagaatttagttttataagtttttaggattttcggtaggaagacggtttaagtttttggatgtgattttgggataggtttttttatttttttttgattaaaatttttatttcgtttttttttaatttatttatgtcgtagttttttacggtttttgtcgtttttgtagcgaatttttggtaaattaagtataaaattcgttgtttgatcgatagagaaggttgtttattttttaaaaataaattgtagttttttcgtaggagtagcgcgggtaagcgaaatgaatttgttgggttaatttcgcgttgatttcgagttgtaaattaggggttcgcgtattaatttttattaattattcggagttagttaaatggtttggttttaaaaatgggaagagtaattatcgagtaatgttatttgtttggggttattcgatttgatattatgatatttaagggaaagttggtgagggggaaaataagggttttttttagttgggtttttagatggcgattttgcgttttttttttttttttttttatgggatttattttgcgtttaggggttcgattttgattattgttgtaggagttaatttttttattttttaggttggataattaattttttttagagtgtgtttgatattgtatttttttttttttttatggtagtgtttcggttttttgttttagtttttttttagggaaattttagtatttttttttttttttaaagtgagaaaaagagcgtggagttttagttggaaaatatagttttttataatttttgttattaaattgttttaaatttatattttataagtttttggaaagttgttgttgtttttggggaaaaggatttttcggttaaagatacgttattggtttcggaatttaaggatggggttttatttttttataagtttcggagtttgtggtttgaagtttagatataatggttaaggagagttgtttttatgggattttggtagggttattttagtagttttagatttttttggtttaggattgttttgggtttttaaattttataaaatttttaggagtaaattgggttaaatagtatttatttttttatttttgtattatttgattaaagtgtttttaaagatttaagtaggatttagtcgatgagtaggatttagggtatcgttatttttattttcgaaatatatacggacgtttatgtatatatattattatttttcgtttagaaaaaaaaaaaaagaaaaagaaaaaaaaaaagtttttttggggtaatagaggtatgagtttggagggtggtgtggtagagtgtaagggagggaaggagggggtaaattttaattttcggatagtataggtttaggtttaagttttatatattgtttagtattatatattggggatttgagaagttattagtttttattatatgatttcgagggtttttattttttttttgttaagtgggtaaagataattttcggtttcgttagtttttttgtatgggcgagtacgtttgggtttttatagatttttttttgaaatttgaggtttggttttttttgaggtttatagatgagtttataaacgaaatttggtttagggtatttattattgttcggagtgaaggtcgaatttttgaaaggatattaaaaagagagagagagaaagagagatagatatagagagagagagagagagggagggagagagagagagagagagagagagagagagagagacgaaatagaagttacgaagaagttttttttagacgaatttttttttatttttgagtttaggagtaggtagggatttagggtattgtataatttttagagttttgtttcgtaattgttcgtgttcggcgagggtcgtgggtttcgagtcgcggtatttattttcgagacgttcgttcgtattttagaattcgggtttaaggatgttcgtggttcgcgagtttttttaggtttttttttagatcggatacgtagatttcggcgggtaaagatcggttttaaatttttttttttaggttttttcgggaggggtagtggtgaaagcgtttgcggagcggagggaggttttttttaattagaagtttatcggatacgggtttgattagagcgcgttgtttttgggtttagcgtttggtttggcgcggagagtgcgggggtaggggttaggggaggtaaagttgtcggttggaaggagtagcgtgtttaaaggttttttgtataggttttggagggagagaatcgagtggttaaggtagcgttttttttacggttagtttcggttcgggaggggagcgtaattttgatcgtgcgttaagaggcgagacgcgttttgtgtttttttttttcgtcggcggttgtagagaagtcgggaatcgtttggtttggtcgggtcgtgagagttgaggggtgaaatggatagtaggtttagttaggaaggtgtttagaaggttgaaaacgatgattgtagttgtattgtgattggggaaaatttgttttttaataaaatatttttttttgtgtgatcggaagagggagtttttggttttcgggcgtcgtaggttttcgtatttgattttagggtggtttgatgattttaggtttaattatgttttagggttttgcgagtttgcggggttgcgggattagtggattagtaggtaatttttttttttttttttttttttcgagacggagtttcgttttgtcgtttaggttgtagtgtagtggcgcgattttagtttattttaattttagtttttcgggtttaaacgatttttgtgttttagtttttcgagtagttgggattataggcgttcgttattaagttcggttaatttttttttttgtatttttagtagagatagggttttatcgtgttggttaggttggttttaaatttttgattttaggtgatttaatcgtttcgagttatcgcgttcggtttaagtaagtttttttttttttttttttaagttttgtatttagtttggggttatttaagtttttattttatatttgtttttataaattcgttaatttttatatatggattaagagtttggtgtttttttcgtaggttagaagaaatttattttaacggtggggttaagatttttggaaaaggagtagaaatattttagtatggtttgggtttaaattttatttttgttatttaattttatagaatttggatttttttatttaaaataaggggtttttttaggattagttggtgagttttttgtaaaggttttcgaggttattgttttaattaatatttagaatttagtgtttgattaagtaggcgattgatgtttgttaaattaatgtttataagattaggatgtaagatataatatttaagaatttaaaatatgaatatgtttgtgaagttttgggcggttgtgagtgggtattaataattgtttttgtttgtgtattatggttagattgttttagggatttagagacggttttgattttttttttttggggtttggttttggcgttttgatggttatttttatatttttgagagttgatgtttttgttttttatagtttaagttttgggttaggttttgtatttttggggaagtagtaggaattttggaaatttaaagaataaatttagaatttcgagggttatttttgtttattttaggatagtagtcggagcgttttttatatttaagttgtttaatgagttttaagggttgggtaagatggatttatttgtttttattgtaagataaaatttaaatttggagatggtgtttttaggttatatgatttgaatttagggttttttttttattgggttttttttttagggtggagaagaaggatatatttatttattagttttggtttttttttaattttttttttatggtagttacgtttgtatattatagaagaatttagatattttttagaagtgtaatgtttgttggttgtaaaatttatagttttattttttacgatatgtgataagattttaggtattagatttgttttgaaaagggttggataagggatttaaacgaagcgatagaatttaggttttaaaaattttttagaagtattaaaaagataatggcgtagtagtattttgtgttttaggggtatggattcgatggttttttaatcgtttttaaatagtatatatgtagatagtgttttcggatttattgttttttagttatagatgtttagatgggttgtcgagttttatatttaaagttttaagagggtggtgggtagcgtttttgtatttatggagtataattttaagtcggatttaatttttaggttgtttattttagttgtttttttatagacggggatattgagatttagaaattttttaaaagtaatattagtttgttaaataaaggtggcgcgatttgattaaagaatataagttttagcgattagtaagttgttttaacgttttttgagtataaaatattaattttattaattaaaagtatagagtggaggtaatttttgggtttgtttgcggtttttttataggatagtgattttagattttttcgaagaaaagggcggtttcgatttttttaaggtttcgcgggggtcgggtgtttttggttaggttaaggtaggagcggtttgaagacgcgcgtttagaaggcgcgggtgaaggcgggtaataagggtagagtttttttttcgagttttgggcgaaggtattttttgtaaaagatatattttgttttttacgtattttaaaaatatttcggtttttaggttttcgagtaattttgttttaggaaaagtattcgttattgtattagtaaagcgtttattaaattatcgaattaaatcgaattggtttaggtttttaatagcgtggaaatttattgaaaataaatgaagagggtaaattataggggtttcgtaggttcgggttcgcgtcgtttaggcgaaagagaggtgggcgggtatcggcgcgggatgagaaattaatttgatatttatcgtgtgtcgagttttttttttgtattttgattaagtatagcgaataattttgtttttgttttaattttaggttttgaagaaatattgttttagttgagtttcgcgtttataagatgaagaggcgttttagatgcgttgaaagaaaggttaaagttcgtgtttttttttattgtttgcggtagaatttggtttcgtatagtttggattcggataagttaagtttttttttatttttagaatttgcgtggtcgtcgtttgagcgaagtttagtgaagatttatttttgtattattatacgcgggagttatttacggatacgacgttgttttagaaagttatttagttattggaggtgtatgtgtttattttagttttttacgatatttaatgtgtatttaagtgtgtgttaatatcgtattataagggttggaggtgtttttggatattttagcgttgcggaggtagtatagtataggcgtttattttcgcgttggttttatttcgaatttagagtttagacgtttgaaaagcgttacgtttggtgataatttggcgtttttttaattaataaaattttttttaaggtagagttagatattgcgtcggttttttggttttattttcgtggggattagtagtttcggaatttttcggattttaaggggttttagacgttttttcggtttttgcgaatagttaggtttttagttttgtttggttttggaggatgtcgggggttagtgtttgcgtgtatttttatttttcggttttttttttagtcgtcgttttcgttatttttacggtttttgggaagtagttgggtaagagttgcggttaaaaggggtaggagaggggggtgttttagagcggagagtttttggcgttattgtttcgcgcgtagggggcgtttttcggtttatttattttgattgcgaatagcgggttggttttcgaggtagttgggtaggtagggcgcgttaggaaatattttggtttggtcggatgacgtttggttgggcggaggaggatcgaagggttcgtagcgataggtttcggttgtgttagtgaattggtcggaaaagtggatagtgaaggcgtttaggtattgtttttcgtgcggtttcgcgtcgttttagttcggtttttgtttgatgaaggagtgaggcggcggcggcgggggtggcggcggagtcggtggcggcgcggggtcgtttaacgattcgtaagtcgaagcgttcgggggcgtaaagtttagtatcggcgtttattgcgtcgcgtcgtttataggtagggtatagtcgtcgtcgttatttagggaggggacggcgggtagtagcgcgtttaggtttcgtacgtcggagtttatttgttgcggtttagattcggacgtttcgcggttttttcggttttggagacgtttagcgttggtttcggcggcgtttaatttggtttagatgtcgttcgggtttcggattttttgttgttttggttgttgtaggtatttaggttcggagcggagcgtgtgttgagacgtcggtttcgggatatacgtggaagtcgggttttgtagtaagaggaagtttaggatcgcggcgaggagacggcggggttcgggcgtttgggttgtcgtttcggttttgggtgggtgggtgggtgaatgagtaggtgggagggagggcgggaagtgggggagcggataggcggtcgggttgcggagagttttcgggtgtgggcgttgttttgaattttttattttagttgtttggttgtttttagttttttaaagtttaaataagaggggtcggcggcgcggggaagaggaggagttaggaggttcggtcgttttatttatttagtagtttaagttcggttaggtagcgcgcgttgttttttgggggcgttttcgtagttggggtgagggcgggttcgagggagcgtttttttcggagatatttttttttttaatttaatacgcgtttttagttggtcggtgtggtataattttttttttattttttttttttggttttcgttagtgtgggagtttcgttttattggagagttcgtttaggtaagtagtgagttcgggtagggtcgaatgcggtgggagtagagatggggttgttaatttaaaagagtggtttggagggaggggtaggtaggttttaagagggcgggaattttaggaaagcgtagaaagaatttagttaagttttaaagaagcgtatatttttgttttgtatttttgagtttggtttttgtttttagaattgtcgggtaggggagtggttatgattttggggttattggggaaagaggtggttttttgtgggttttagaggtcgggattgaaagcgaacgttttttagttgggtggtcgggagttgtattagttataagtcgggcgtatttcgatcggttagtagttgtttatttggtgaggtttgcgttaggcggaaggcggttgtcgtttatttaaaattggagttagtagtatttagtttttttttttagtgaggaatatttaatttttttacggttaagtcgggaaaatagcggttagtttaggagggaagaaaatttttgggtaaacgtttaaagtttgcgtatatttcggtcggagtattttggcgtttagtttggggaggaggggtgaaggggagggtttggatacgaagttcggtagggagcgggtaatttttggagttatttcgtcgagtattgtttgtggttttggtcgaggatattattttggttgtttagtgattgattaggaggcggaagttagttaaggggattaaggagtggagtagggagaatttttatcggtttacgggcgcgagttagtgttcgaatttttgggagttcgaagagtttcgttaaatttgatttttttcgtttagtttttgtttggtagttttcgcgttttagagtaggtgtttggggcgggtagggggtgttttggtttggtttttggattttttaaaggagttagtatttattgggaaataatttttaggtaaggagaagaatcgggggtcggagcggagcgtgttttagaggtgcgtataaaattttaggggcgttaggaggtagtagcgacggcgtagcgtgggacggttaggcgcgacgggagggaagtaatcggttgtagttcggttttttgtatttggttggttcgggttggggttgtaagttttttagttaaatttatgtgaagtaaagtagttgtagtttgataaagaatggcgttttaataaatgatatagtaattttttacgttttggtttttagtttgtattgtataaacgttgtcgttattaaattttggttgcggattcgaagtgtgtgcgggtttaggatttattcgaagggcgtattttttgggaatgcgtatttcgtaggcgtaggagattttgagggtaaagatgcggtatttgagtttttcgtttgttttttaggttatttttgttgtttgattttgcgtcgtttttatttagaagtttttaaaattattattaagaaaagaaagattttataagatattgtttttacgttttttgtttagtttttttttatacgatttatttttaaatttttcgcggggttcgcgcgtttggttttttgagtggagaaaggattttcgagataaaatttattgttagttgttttaagaattttttagatttttgtatttttttttttttttttcgtttattatttttatttggaagtcgttttttttaattaggatttaattgtgaggggcgaggagttttttatgaaaagtcggggatttttatttttaaacgaaaagattgagattgtttttttttttattatttttggtatttttagcggggggagaggaggttatttgaagggaggttggtttgaatgtgagtcgttgtgtttgtgaaatttaggtaaggtaaagatacgtaaatttttgttaatattttttaaaaataagtttttgtttcggggtgagggatgtaggggtggataggaggaaaggagagttaagtaaatgtagaattttttttttttttgttatttatttttttagaatttttgtgggggcggggaggggaagagtatcggtgcgaatttcggggtgttttttcgttcgatttggattttttcgattaaagaggtgggaggagttttttgtagtttgcggggttaagaagaaagtgttaagttgaggagtcgtagtcggaggattttagggattcgataggaagttttcgtacgattttaacggatttatatgttcggaagtttaggcgatattaagttagcgttggggaattgacgtatttttgtagtcgtagggcgttttatgtttttttgtttttttttttgttgtgggtaacgttttttgcgggagatttgaggttttttaagggggatatgttagttatattggttttggcgttttgagttaagtattaggatttatagtttagtacgaaggtaggtagtatttttattcgtcgcggacgataggcgtttttttgtattttttttagttcgcgaggttcgtttttcgcgaggttttagagaaaagtaggttgtggaaaattgggcgttttttttttttatttatttttttatttttgttagcgtcgagatttgtagtagaggtttttggtttgaattatcgattggtaaagaaagttgtagattaaatttttcgttttatagagaaggaaattgaggtttagatagtcgaaggagaggtagtttatggagcgtagcggtaaagagtaaggggttggtggttttagaatggaattttagttttgttaggtaattaatagttgtgtgattttagacgagtttcgtagtttttttgagttttagtttttttattggttaaacgggataatgggatattagcgtttattttatagagttgttttgaggattagataggagagtagtgtgggtttttgatttaattaattttatagtttttgttattattattgtttaaggataggaaataagttagtggtaacgtcgagttgaaattcgggttttttaacgtttagttggaggttttatttattatttttttatttttttagagttaatgggatgtagaggcgaggatagtttttggaaaattatgtggcgttgatatattggtaaagcgtaggtatttcggtttcgaaggtgtataattattgtaatatgaaaaaatcgaggttgggtaggagtagggtagtgaggattttttaatttttatttttatttcggcgttgtttattgtatttgatagagcgcggagttgggttgttatagtcgtaattttagggattagtgcgtacgtttgggtcgtttttcgggagttatttagcggtcgcggataattgaataaatattttaaagcgttgcggtcggttaagggcggggatagttatattgcgcgcggggttcgtaggtcgtaataaagagtggttcgatttcgttgttgtttgtcgcgggagaggaataagttttcgattagcgttttttttcggggttcgcgtttcgagttttacgcgtaagatagtttaatagttgtttttttttttttcgtcgattttaatttttcggaatttgtttattcggggttgtagggtaagtgtttaggatggtttttagtttcgcgttggcggtgaaaattttaacgttatttttttaattaaaaaaaggggggggtaagggaggggttttgtgataattatttttagttttttttgattattttaaaattaagtcgattttttttaattagtttttatttattgttttaatttttttcgttgattttatttgggagttcggaatcgttaggtattgtcgaatgcggtgtaaaattttttttttttttttagttcgtagtgtttggagtcgttggggttattcgtttgttttgatgttatcgcgagatggttttcgagtttttcgagagtttttagtgaaaggatttcgcggtattgtttttattattatatcgtaaatttttttaaattttggaattaattatatagaggatatgttttaatttgttttgtattaatgttatagtggggatggaggttaggtcgtggttagagtagatacgtaggtttatgaaattgatgaattgagagttgtttttagttttgagcgtattatttggaattttagtttgaggttataattagaatttttgattttagatttaattttgtaaataataggggaaaaaaatggggaaaagaaaaattacgagagagggaaaaaaaattattttgtatttgtaaaaaaaaaaaaaaaaaaaaaaaaaaaaaaaaagttatataattttaaaattttttcgttttagataat

SEQ ID NO: 177 - DNA, 8588 bp, Artificial Sequence
  chemically treated genomic DNA (Homo sapiens)
  unsure (4416, 4418, 4430, 4434..4435, 5243, 5245, 5612)
atttttatttatttatttattttgagatggagttttattttgttattaggttggagtgtagtggtatgatttcggtttattgtattttttgattttttggtttaagcgatttttttgttttagcgtttcgagtagttgggattataggtatgtattattacgtttagttaatttttgtatttttagtagagatggggttttattatgttggtttagatggtttcgattttttgattttgtgatttatttgttttgattttttaaaggttgggattataggtattagttattattatgtttggtttataatgagatgtttttgtgtaagaaagaaatggtatatttttttaatttatagatattaattttagtttttttattttattttgttttttatatattgtaacggatagaatatttgtgttttttgaaaattagtatgttgaaattttaaattttaatgtgatggtatgaggagataaggtttttgggagttagtagataacgagggtagggtttttatgaatgaaattagcgtttttataaaagatattttagaaagttttttagttttttttttttttttataagagagtataggaagaagttatcggtttgtaattcgaagagggtttttgttagaatttaaattatgttgacgttttggttttagatttttagtttttagtattgtgagaaataaatgttgtttaagttatttagattatggtattttgttatagtagtttaaattgattgttatagtagatttataattttattttattatttttatttttggtttagaagtattttaattaaaatagttatagttttttttgttttgtttgagaatggtttaagttaagtgatatattttttttatttttttatgagtaagagatttttgggatttattgtttaatgttattttatagaagaattgtatagattttttagattattaaattgtaatttttagatttagtagttttgttatttatttttttattatgtttttaaaaggtagtaatttatttgtaggtaattgttgattttgtttttgattgatttgaggttttatagattttacgtagattatttattggggttttaatattatagatagaatatttataattttttataaatattttttatattaaattgagtttgatggaaataggggtgtaatttatattttatttttttaggttaatttttttttgaaatgagtattttgattgggtaaggtggtttaggtttataattttagtattttgggaggttgaggtaggaggattattcgtttataggagtttgagattagtttgggtaatatggtaaaatttttttttataaaaaaaaaaaaaaaatatatatatatatatatatatatatatatatatatatatttatatttatatgtatatatttatatatatatgtattatatatatgtatatatttataatgtataatatatattatatatatatatatttatttataaaaaattagttaggtatggtggtatgtatttatagttttagttgtttagatggttgagttagggaggatttttttagtttgggagagatatagtgagatattttttttaaaaaaaaaaaaaaaaaaagatttttttttttttattttgttttagtattatatataattatatttttgttagagttagattggtaattttttttgagatagtgttttattttgttatttaggttggagtgtatagtttgtatgatggtattattatagtttatgtagttttaattttttaggtttaagtgatttttttattttagtttttcgagtagttgggattataggcgtatgttattatgtttagttaattattgtatttttggtagagattaggttttgttatgttgtttaggttggttttgaatttttgggtttaagtgatttttttatttttgttttttaaaatgttgggattataggtttatggtaaaattgattttgttatatgtttttgtaggttttttttattgttgtttgtttgttttgagaacgagtttcgttttgttgtttaggttggattgtagtagcgtgattttcgtttattgtagtttttgtttttcgggttttagttatttttttcgtttagtttttcgagtagttgggattataagtgtttattattacgttaggttaatttttgtatttttagtagagaggggttttattatgtggttaggttggtttcgaatttttgattttaagtgatttgtttgtttcggttttttaaagtgttgggattaaaggtatgaattattatgtttggtttatttttgtgtttaaagtcgtagtttttaagattttttttatgattatgttaagtgaggatttattgtatttgtatatattgtatttgtaaatttttcgttatttttatttttagattgtttataatattttatacgatgtaaattttaaattatttttatattgtttataatgttttatataatgtaaatgttatgtaaatatattgtattgcgttttattttgtattatttttattgttgttgttgttttttaatgttttttatttagggttggttgaaattgaggatggggaatttaggatatagagggtttattgtatattatatattatatatagtatattatatatgtattatatatgtatataaaatggtttgatattatttatttatgtaatgaataaaaatttaggtttgaaaattatttaaaataattttggtatatttaaatattgagttgttgcgtttttttttattggagggggagttagaataagtggtgttttgaggttagttatagtttatcgtggatgaatatttgttaaagaaaattgttattaatttaataaattatttatttattttttggtggtataaagggtttagtaaattttggtgggttatttgtttttaagtaaagaataatttgtaaagttgatttggaggacgtttgggaataaacgagaggtaattacgtgaaaggtaacgtgtatgtgatttttatagaaaatattatttgatgatgatttagtacgtgaagtgtagttagggtaaaaggaaaatttgagtgttgtagattaagggtattaggtgggacgtagttggtatgtaagtttagttagttaaaatatgcgttgttaaattaattatttgggattataatgttttggtttttaggaaaggttgtttgttgaagtagttaaattttagtttggagagatagagttgaaattttaaggagatttttttaagaagtatttcgatatttttttcgatattttgagaagattacgaggcgttaagaatgtacgttttgcgttttattttaattttttttttagttatttggttttaaaattaggtttttaaaatggattagagaggtttggggtttaaaattggtttcggaagcgtttttttttttttttttttttattttttttagagtttaaaattgggtgtgttttttttttttcgaacgtagtttttattcgaagggcggattttgattttcgcgggtttaggttttcgtaggttggcgggagtcggtgggggcgggtcggtcgagttcgggggaagtaaagagaacgttgtcgcgcgtttcgattaaattcgcgtcgttattagtttacggacggcgttttattttttttttatcgaagagtttttgttatcgaagaggtttagttaatgagcgggcgagaaggtcgggtttgcgaattaggtatcgggagggagagggtcgtagggggaagggaagtcgagagttcgagggcgggttgtttttgattgatagttcgttcgaacgaattttttacgcggttttttttcgtttttttttttatttatttttgtttttcgttttattttttttttttttatttttttttttttgtttttcgattttttttatttttttttttttattttgcgggtaaatcgttgttgaaaagaggtaggggtcgaagcggcgggttcgtgtggagtcgtgaggcgggattgattggcgttcgggttaatgagagataggtttatggcgcggttgtagttggaattgattaataggagggcgggttgggggcggaggtttaggttttaaacgtttcgcggcgttatgggttgaaaatttaatcgagatggaattttttagtttgaatcggttttaatcggtttcgagtttgaggtattaggaggagggggagaagcggttgtagcggtcgcggtaggagtagcgggagttatagtattagtaagagtaatagtagttatagtttcggcgcggtgtttgttttagtttttgttgttgtagttcgtgtaattatttagagggggagggggtaattattagtcgttgaggaataananaagaggcgatantttnnncgagtttaagggggggggggattagttcggagtcgcgtgagagagggagtcgtgttttggtaggggggaatcggattgtaattggtagtagagcgttttttcggtcgtgtggattttatattttttatttttgtcgtttttgttgtttttgtggttggagggttttggggttgaatttttgggatttgatttcgttttttttttttttttttattttttagtcgggcgggagtatttattttttagattaattttttttttgggggggggcgggtgtgtgtgtgtgtgtgtgtgtgtgtgtgtgttgggggaagcgtttttgaaatagtaaatattattgagttttttttgttttttttttgttcgtttttttaatttttttttttgaggtgggaaaattgaaatttattttgattcgtttttttttttttttttttattttttttcgttttaattttttaacgaggaaggaaggagtagttggtttaatttttgggtaagtcgattgtgttttcggggtcgagggtcgggcggcggcgcggcgggtcgggcgggaggaggtcggcgtgggagcgcgcggcggcggtcgcgggaagcgagttcgggaggcggcgggcgggtcgggggcgcggcgggtttatagcggagtttgcgattgaatggagtcgtttttgtcgttgggggatggaggcggggaggcggtttcgggaggggagcgtttgttgggttattcgcgtgtgcgggtggcggtggaggaaggcgaggagtgtgatagtgaagcgggtttcgcgcggggtgggaggggtntntttttttggggttggggagaagttggggtgattttaggaatatttttgtaaattattaggagtggaagtttttagaaatatttagtgtagtagtattgaaacgttcgtttgtattacgtggttttttcggtggagagtttgggatgggggagggaggggttgtcgattttttgtttttttagtaaggaaattcgaaagtttttcggttttgtagagtggtatgtgaagtaggaaagattagttttttaggggtttgtatatgggatttcgttttgtagtttttttttaggggtttgaatgtgataagttggttaaattatttattgtggttttgtatagtgacggatgttttgatttttttttattntcgatgtttgtgagtttgggttgggtgggaggaagtggtgtagtagaggaagtatttagtattggtttagtcgcggattttttttgattacgtcgaggttatgttgtatagagaaaggggcggtgaatttaaggcgtttggtttaaatgtttttttcgagtaagggcggggtgagtgcgtgtttttgtgtgttatagttagaagggttgtaaatcggttcgggtgggaagcgaggggagggcgggttttaatgaggtgtgttttttttgaatgaagcgggcgattgtttatataatttaaggagtagtttttcgttttgtagcgatttgttttttatttagtgtgaagttattaagtaacggttatgattttttgggttttgtttaggaattggtattgggtgttatttgtagagttatattatttattaagttggataatttttagtgtatgttatttagtgagtggattttaggattgaagagtttaatgggaatgagcgttcgtggttatatttttcgtattatggtttgtttgttgtttgattgtatattttaagtgtgggatattgttgttagtggaaagaatgttttggaagcggtttgatttgggggattaaatgtgtttggtattgattataaagtcgttatttttgtattatgtatagtttaggaataggtaggtgatttcgaagatagtcgttagttttaaggatggtaaattattgtatttaaatttttttattttaaatttcgttttttatattagtttagttcggagaattttataagaatagtgtatttgaaaatgaaatttgtaagagttatttttttaatttttttttgttttagtatttaattatggtagtaaataggtgaaaagtttgtttaatatttaatcgaaatatttgaaaatttttgatatatggattttggtgttttgtggatattgtttttaagttttaaataattaagattgttttgattttttaaattttatggtatttgaaggtggaggagagtttatatatttatttgtggaatatatatttttttttagtatttagattttaaggtttttttgtggtgtgtaataagtattttgttgtttaaaaacgtttgtttaatgtttattacgaaacgttttgaagttttattagttttgttaataatggattaatttttgaatttttaattttttgagttttatattatttttatattatattaattataggtgatttattttttggagttttaatttgttgtaatagacgttatatttaaataagataattgtattaaaatagaatttgttgttattattgttatggatatttttaagttgttataaaatagttaggaattaatgatttttttttcgttttgttaagttagtttgtttaaatataatgtaaagaaattagttatttattttttggtttacgaaagtttttaaaatgggaagaagtggagatttgattttgttagttttaaatatattaaattgggagtgttatggatggtttttaggatgttttgaattttttataattgtatataaaatcgtgagtttttaaaaattgggttagagttattggttttttagagttttaggtattttagatttttaaaaaggttaaggattattgatttaattaattaggtttgagtggtattggttttgaagaaaagtagaggaaagatatattttataattttgggtaataaaaaagtggatgtgtgttagtattttagagtagaatttttttaaaaggatagtattgtatatgaattagtaggttttaattagtgtatatttaggcgaagtagtttatttttttgttagaatttttttttatttgggaatgggtaagtttttatagtttttattttgttaatgaatatttggaatttaaaaaattttgttaggtatattgtttataaagtttttttttttagattatatatttagtaaatatgtttgtagttttattttaattttttaatttattgagggttgaaataatttgaatggtttgagtgtagaagttaagttatttttgtagaggttaagcgtatatatattaagatatgttagatttgtggttttgttaattattgttgtagataataggaattattgtatatttatattttaatttttaatattattttgtttttgtttgtttgtttttgagatggagttttatttttttgtttaggttagagtgtggtggtgtatttcggtttattgtaaatttcgttttttgggtttaagtagtttttttgttttagttttttaagtagttgggattataggtgttcgtttttatgtttggttgatttttgtatttttagtagagacggggttttgttatgttggttaggttggtttggaatttttgattttaagtgattcgtttatttcggttttttaaagtgttgggattataggtgtgagttattacgttcggtttattttgtttttatagtattatttttataaagttaagataatgtgaagtgagtttttattgagttatttagaagattttatttgggaagaaaagaaaattatatttatttgaatttaattttatttgtttaaaaagttttgatattaagatattgaattgtattacgttttaggattataaaattttaatagtggatgcgtttaaataataggttagtatattttataaatgttagtagaataggaaagtttttttggtgtataaattaaatattagaaaagttgaatggattataataatttatgtaattattaaatagttaagtaattttagtttttgttatttgtttttattattttagttttttgtaattaaagtttttaaagtatttattaaaatatttgtaataatatggttgaagtaaaataatttgtaggaagtttttgataatattaaaatttgataggtagttttaattttttttttttatttttagt

SEQ ID NO: 178 - DNA, 8588 bp, Artificial Sequence
  chemically treated genomic DNA (Homo sapiens)
  unsure (2977, 3344, 3346, 4153..4154, 4159, 4171, 4173)
attgaaaataaagaaaaaaaattgaagttgtttattaagttttggtattattaaaaattttttataagttattttattttaattatgttattataaatattttaatgaatattttagagattttaattatagaaaattgagatagtaaaagtaagtaataaaagttgaaattatttagttatttgataattatataaattattatggtttatttaatttttttagtgtttagtttatatattaggaagatttttttattttattaatatttataaagtatgttaatttattatttaaacgtatttattattaggattttatggttttaaaacgtgatatagtttagtattttgatgttaaaattttttaagtaagtaggattaagtttaagtgaatgtgatttttttttttttttaagtagggttttttgaataatttagtaaaagtttattttatattattttaattttataaaaataatgttataaagatagaatgggtcgagcgtggtggtttatatttgtaattttagtattttgggaggtcgaggtgggcgaattatttgaggttaggagttttagattagtttggttaatatggtaaaatttcgtttttattaaaaatataaaaattagttaggtatggaggcgggtatttgtaattttagttatttgggaagttgaggtaggagaattgtttgaatttaggagacggagtttgtagtaagtcgagatgtattattatattttagtttgggtaagagaatgagattttattttaaaaataaataaataaagatagaatgatgttaaaaattaaaatgtggatatatagtaatttttattgtttatagtaatggttagtaggattataagtttaatatattttggtatatatgcgtttagtttttatagaaataatttagtttttatatttaaattatttaaattgttttaatttttaatgaattgggggattgaaataaagttataaatatatttattgaatatatgatttaggaaaaaaaattttatgggtaatatgtttaataagattttttaaattttaggtatttattggtaaggtaaaagttgtaaaagtttgtttatttttaaataaaaaagaattttaatagaaaaatgagttatttcgtttaaatatgtattggttaaaatttattagtttatatgtagtgttatttttttaagaggattttattttaagatgttggtatatatttatttttttgttgtttagaattataaaatatattttttttttgtttttttttaaagttaatgttatttaaatttaattggttaagttagtagtttttaatttttttgggggtttaagatgtttgagattttgaggaattaatagttttaatttagtttttaaaaatttacgattttgtatataattatagaggatttaggatattttgaaagttatttatggtatttttagtttagtgtatttagaattaataaggttagatttttatttttttttattttaggaattttcgtggattagaaaatgagtagttaatttttttatattatatttagataaattagtttggtagggcggaaaaaaagttattaatttttggttattttataatagtttaaaaatgtttataataataatggtagtaaattttattttaatgtaattgttttatttaaatataacgtttgttataatagattagaattttaaaagatgagttatttatgattgatatgatgtaaaaataatgtaaaatttaagaaattaggagtttaagaattggtttattattgataaaattgatgagattttaaaacgtttcgtagtaggtattaaataaacgtttttaaatagtagaatatttgttatatattataaaaaaattttaagatttaaatattgagaggaaatatatattttataaatgaatgtgtaaatttttttttatttttaagtattataaaatttaaaagattagaataattttaattatttgaggtttaaaagtaatgtttataaagtattaagatttatgtattaaaagtttttaaatatttcggttaaatattgaataaattttttatttatttattattatagttgaatgttaaaataaaaaaggattaagaaaatgatttttataagttttatttttaaatatattgtttttataaaatttttcgaattagattgatgtgaaaaacgagatttagaatagaaggatttaaatatagtagtttgttatttttagaattagcggttattttcgaaattatttatttatttttgaattgtatatagtatagaaatggcggttttgtggttaatgttaagtatatttagttttttaaattaaatcgtttttaaaatattttttttattaatagtagtgttttatatttaagatatataattagatagtaaataagttatagtgcgagaggtgtaattacgaacgtttatttttattgggttttttaattttaaaatttatttattggataatatatattagggattatttagtttaatggataatgtgattttataagtgatatttaatgttaatttttaaataaaatttagaaaattataatcgttgtttaataattttatattaggtgaaaaataagtcgttataaggcgaaagattgttttttaggttgtgtgggtaatcgttcgttttatttaggaaaaatatattttattagggttcgtttttttttcgttttttattcgaatcgatttgtagtttttttaattatagtatataggagtacgtatttatttcgtttttattcggaggaggtatttagattaggcgttttaagtttatcgtttttttttttatgtagtatggtttcggcgtgattagaggaggttcgcggttgagttagtattgaatgttttttttattatattatttttttttatttaatttaaatttatagatatcggnaatgaaggagaattagggtattcgttattgtataaggttatagtaaatggtttaattaatttattatatttaaatttttgaaaaggaattataagacggaattttatgtgtaggtttttgaaaaattgattttttttattttatatgttattttgtaaaatcggagagttttcgagtttttttgttggaggaatagggagtcggtagttttttttttttttattttaagttttttatcgagggggttacgtgatgtaggcggacgttttaatgttgttgtattaaatatttttggaaatttttatttttaataatttatagagatgtttttgaaattattttaatttttttttagttttagggggangngttttttttatttcgcgcggggttcgttttattattatatttttcgtttttttttatcgttattcgtatacgcgaatgatttagtaagcgtttttttttcgaggtcgttttttcgtttttattttttagcggtaaaagcggttttatttaatcgtaggtttcgttgtgggttcgtcgcgttttcggttcgttcgtcgtttttcgggttcgtttttcgcggtcgtcgtcgcgcgtttttacgtcggttttttttcgttcggttcgtcgcgtcgtcgttcgattttcggtttcgaagatatagtcgatttatttagagattgaattaattgtttttttttttttcgttgggggattagggcgagggaaggtggggaggggggagaggggacgaattaaggtgggttttagtttttttattttaaaaaaggaaattaaaaaaacggataggaaaagggtaaaaagagtttaataatatttattattttagggacgttttttttaatatatatatatatatatatatatatatatattcgtttttttttaaaaggggaattaatttggggaataaatgttttcgttcggttggggagtgagggaagggggagggaacggggttaagttttaaagatttagttttaggattttttagttataggagtagtagaagcggtaggagtagggggtgtagagtttatacggtcggggagacgttttgttgttagttgtagttcgatttttttttattaaaatacggtttttttttttacgcggtttcgggttggttttttttttttttaggttcgnnnaaantatcgttttttntnttgttttttagcgattggtggttattttttttttttttgggtggttgtacggattgtagtagtaaagattggaataggtatcgcgtcggggttgtagttattgttgtttttgttgatgttgtagttttcgttgtttttgtcgcggtcgttgtagtcgtttttttttttttttttagtgttttaaattcggaatcggttgaaatcggtttagattgggagattttatttcggttgagtttttagtttatggcgtcgcggagcgtttggaatttgggttttcgtttttagttcgtttttttattggttagttttagttatagtcgcgttatgagtttattttttattggttcgagcgttagttaatttcgttttacggttttatacgagttcgtcgtttcggtttttatttttttttagtagcgatttgttcgtagagtgggggaggggaagtggggagggtcgaaaggtaagaggagaggggtggaggaggaggaggtgggacgaagagtagggatgagtagaaaagagagcgaaggaaagtcgcgtggaggattcgttcgaacgagttgttaattaagagtagttcgttttcgagttttcgattttttttttttttgcggttttttttttttcggtgtttagttcgtaggttcggttttttcgttcgtttattggttgggttttttcggtgatagaagtttttcggtgaggagagggtggggcgtcgttcgtgagttggtggcggcgcgagtttgatcggggcgcgcggtagcgttttttttgtttttttcggattcggtcggttcgtttttatcggttttcgttaatttgcgggggtttgagttcgcgggaattaggattcgtttttcggatgggggttgcgttcggaaaagggagggtatatttagttttgaattttggaaggggtggagaaaagagggaaaaagaacgttttcgaggttaattttaggttttagatttttttaatttattttagaggtttggttttggggttaggtagttgagagaggggttggggtgaggcgtagggcgtgtatttttggcgtttcgtgatttttttagggtgtcggaaaagatatcgaaatattttttgggaaagtttttttaaaattttaattttgtttttttaggttggaatttggttgttttaataagtaattttttttgaaaattaaaatattgtaattttaagtgattggtttgatagcgtatgttttggttggttgagtttgtatgttaattgcgttttatttggtgtttttgatttgtaatatttagattttttttttattttagttgtattttacgtattaaattattattaaatagtattttttgtgaaagttatatgtacgttgttttttacgtggttgtttttcgtttgtttttaagcgttttttaaattagttttatagattgttttttgtttaagagtaaatagtttattaaaatttattaggttttttgtgttattaagaggtagataaatgatttattgaattaataataattttttttagtaaatgtttatttacgatggattatggttaattttaaagtattatttattttaattttttttttaataaagaaaaacgtaataatttaatgtttagatgtattagaattattttggatgatttttagatttaagtttttatttattatataaatgaataatattaagttattttatatatatatataatatatatataatgtattatgtatgatatatgatgtgtagtgggttttttgtattttgggttttttatttttagttttaattagttttgggtggaaaatattaaaaaataataataataataaaaataatataaaataaaacgtaatgtagtatatttatatagtatttatattgtataaggtattataagtaatgtagagatgatttaaagtttatatcgtataaggtattataagtaatttagagatgaaagtaacgggaagtttataaatatagtatatgtaaatatagtaaatttttatttaatatggttatggagaggattttggaaattgcgattttaaatataaggataggttaggtatggtggtttatgtttttaattttagtattttgggaggtcgaggtaggtagattatttgaggttaggagttcgagattagtttggttatatggtgaaatttttttttattgaagatataaaaattaatttggcgtggtggtgggtatttgtaattttagttattcgggaggttaagcggggagaatggttggaattcgggaggtagaggttgtagtgagcggagattacgttattgtagtttagtttgggtaatagaacgggattcgtttttaaaataaataaataataataaaaaaaatttataaggatatataataaaattaattttattataggtttgtaattttagtattttgggaggtaaaggtgggaggattatttgagtttagaagtttaagattagtttgggtaatatggtaaaatttggtttttattaaaaatataataattagttgggtatggtggtatgcgtttgtagttttaattattcgggaggttgaggtgaaaggattatttgagtttgagaggttgaggttgtatgagttgtgatgatgttattatgtagattgtatattttagtttgggtgatagagtgagatattgttttaaaaaaaattattaatttaattttgataaaagtgtgattgtgtatgatgttaaaatagggtgagagagaaaggatttttttttttttttttttttggaaaaagtattttattgtgttttttttaggttgaaaggattttttttgatttagttatttgagtagttggaattgtagatgtatgttattatgtttagttagttttttgtaaataaatatatatatatataatatatattatatattataaatatatatatatatgtaatatatatatatgtaaatatatatatataaatgtaaatatatgtgtgtgtgtatatatatatatatatatatatattttttttttttttttgtagaaaggggttttgttatgttatttaggttgattttaaatttttgtaggcgagtgatttttttgttttagttttttaaagtgttgggattataggtttgagttattttgtttagttaggatatttattttaagaaaaaattgatttgggaagataaagtatgggttgtatttttatttttattaagtttaatttagtgtggagaatatttatggaaaattatgagtattttgtttgtgatgttaagattttagtgaataatttacgtagagtttgtgaagttttaaattaattaggagtagaattagtagttgtttgtaggtgagttgttattttttgagaatatagtgaaaaagtaggtgataaggttgttaaatttaggagttatagtttgatagtttgagaaatttgtatagtttttttatgaggtgatattgaataatgggttttaagaattttttatttatggagaaatgagagaagtgtattatttaatttggattatttttagataggatagaggaagttatagttgttttggttgaagtatttttaggttaaaaataaaaataatgagatagggttataggtttgttgtaatagttagtttaggttgttgtaataaagtattatagtttgggtggtttaaataatatttattttttatagtattggaggttggaagtttgaggttagggcgttagtatggtttaggttttggtaaaggtttttttcgggttgtagatcggtgatttttttttgtatttttttgtgaagggggaaaaaaggttagagagttttttggggtgttttttataagaacgttaattttatttatgaggattttattttcgttatttattgatttttaaaggttttatttttttatattattatattagggtttaggattttaatatattgatttttaggggatataaatattttgttcgttgtaatatataagaagtaaaatagagtagggaaattaaagttggtatttgtggattgaaaagatatgttattttttttttgtataaaaatattttattatgggttaggtatggtggtggttgatgtttgtaattttagtttttgggaggttaaagtaggtggattataaggttaggagatcgagattatttgggttaatatggtgaaattttatttttattaaaaatataaaaattagttgggcgtgatggtatatgtttgtaattttagttattcgggacgttgaggtaggagaatcgtttgaattagggagttagaggatgtagtgagtcgagattatgttattgtattttagtttggtgatagagtgagattttattttaaaataaataaataaataaaaat

SEQ ID NO: 179 - DNA, 5898 bp, Artificial Sequence
  chemically treated genomic DNA (Homo sapiens)
atatatgtgaatattttatatatttagggattatatatattgagttataaaggttttgtatacggttatagttgtagagttatagatgttgatatagttttaaatgtgtgtgtcgggtgtggtggtacgtgtttttagttttaattatttgggaggttgaagtggaaggatcgatttagtttgggaggtcgaggttgtattttagtttgggtaatagagcgagattttgttttaaagtaatatatatatataaagttgtgtgtgtatatagttttagttataggggagggtagttatttttttatttaggtatttgcgcggagttatatatatttagttattgtagattttatagtggtttagagttacgtatagatatgtaggtggggatgaaaattttatgtttttaagaatgtcgttttagagataaattgtagtatagttataatagagtatttattttatatttagagatggttaaagtatatacggtatagtcgattatataggcggttttatatattgatttatatagttaagttatgcgggattgtatgtatatagtttttttataggaaattgggtatattcgtgttttttacgtttttttattgtatatttaggtatataggttttcgtagttttagatgttaaggcgtatatttttgtattcgtaagtatatatattgtttatataatcgggtatatatgacggttagtttaggttcgtcgtttacgtagtcgtaggttagggtatatacggttagcgtcgtttttggttacgttcgtttaggtttaggtaatcgcgttaggcgtatatacggcgcgagtatacgtgtcgcgggtatacgatttttagttcgttcgcgtattcggttagtttttatattttcgcgtttttcgttttcgtttgtttttttggaaattttgttttttttttttttttttttaggtcggaagtgttggttgtatttttagtttttttggttttcgttttttttttttttttttcgttcgtttaggattggttttagcgtttcgcggggggatttcggttatttttttttttatcgttattttagaggggattttcggtcgtcgttggggtcgcggattttttcgttggttacgtagggagtagggaggagttttgttatgaatttttttttggtttgggacgttcgagatttgaggggagggttgagggtttggttttttggatttgatcgaggataggttgggggtttttcgggtttgagggaggaggagttaggggtttgaatcgttggatttgagggaggaggagatgggggtttggatttttgggtttgagggaggaggggttggggtttcgggggatttgaggatttgagggaggaggggttggaggtttggatttttgggtttgagggagggggggttgggagtttttcgggtttgaaggaggaggagttaggggtttggatttttggatttgagggaggaggagttgggggtttggatttttggtttcgagggaggaggggttgggggtttggatttttggattcgagggaggggggtgttgggggtttggagttttgggtttgagggaggaggggttggggatttagggttttgggttattgcgagggaggagggattgaggttttggtttttgggttttttaggtttgtgggtttggggaggtggaggattagtttttttgcgagtaaagtattttttttttttgagagtggttttattttaaaagttttgatttttggggtcgatgatttagtagatgggagagaggagggggatagtttgatttagggatgggaaatgttttcggtttttagggagtagaaattggaattttttttttaggattgatcgtagttcgagttgagtcgggtttcgcgaatttaaggatgtttttaattttttttttttcgttttaattttttaagttgcgtaaggatttggagatcggtttagaggcgggttttaggttttttttttttttttttttttttcgttgtttttaaggttttgtttataggagacgggagttttggttataggagaggaattcgagtgttcgggttgaattttttcgttacggtttttaggaagtttttattttttcgttttttgcgagtgagttacgggcgagtaggaggttataatcgtgttagagtcgttcgcggttcgtttagtttacgagatcggttcgggaaggttttttagtaagcgtcgtattagggattttttttcgtcgttttcggacgaagtaggtcgacgtggagtttggtagaatttttttattttaatataagttcgtagtttgtaagaatgaattttttattattataattgcgtattgtggtaatgatttttatttttatatttttatttagggtatttagttttttagtattttttagaaaatagtttttttagattttaagagggtttttatttagggcgattttttgataataaaagatgtgttagtgtggggaatgatttttgaaaatgtagtttgggcggggtgcggtggtttatatttgtaattttagtattttaagaggtcgaggtaggtggattatttgaggttaggagttcgtgattagtttgattaatatggtgaaattttcgtttttattaaaaatataaaaattagttgggcgtggtggtcggcgtttgtaattttagttattcgggaggttgaggtaggagaattacgtgaattcgggaggtagaggttgtagtgagttgagatcgcgttattgtattttagtttgggtaataaaaacgaaattttattttaaaaaagaaaaaaaaaaggaggttcggtcggtttggtggtttatatttgtaattttattattttgggaggtcgaggcgggttgattacggaggttaggagatcgagattattttggttaatacggtgaaatttcgtttttattaaaaatataaaaaattagttaggcgtggtggtgggtgtttgtagttttagttgttcgggaggttgaggtaggagaatgcgtgaattcgggaggtggagtttgtagtgagtcgatatcgcgttattgtattttagtttgggcgaaagagcgcgatttcgttttaaaaaaaaaaaaggaaaatgtagtttgaaggtatattttattataagagatttatttagttattaattgaggatgattttttttttttttttgaaagttttttttaattaatgtaattattagttatagtgaaagatttttattttgttaattttgagtttttttagagggtaaatttcgatataattttagattttagtatgaggtttgtgttatttgttagttcgaattaggagagtaattttatttttttttttgagagggagtttcgttttgtggtttaggttggagtgtagtcgtttgatttcggtttattgtaatttttgttttttgggtttaagcgatttttttattttagtttgtttttttttcgttttcgagtagcgggattatagggtgtgcgttattatatttagttaatttttgtatttttgtagaaatggggattcgtcgtgttgtttaggttagttttagatttcgagttttagtgattcgtttgttttgggcgtttaaagtgttaggattataggtgtgagtcgggtaggagagtaattttattttggtttttttttgttttaaatgggtatattatttggtattaggattaatgtgcgtaaagtatttagaatttagtttaggtgagttttttttaatttagtttagaagagattattcgttcgagggtgagggggttagagtcgttttgtgaattgggaaaggaggtttttttttagttttgttaggtattttggattttatttaatttatttatttatttatttaattttagtaagtggggagagggagagtagtttaggtttttttatttgtttgggttgtttaggagtgagattatataaggtaggtagtttttagagaatttttttttaaggtttgttggtttttttttggtattttgttttgtagattttttttcgtaagtgtttattttttatagttttttttttttttgtttagtttttttttttttttaatttttttaaatagtattttttgtagatatgggattttattgttgtttaggttgattttgaatttttgattttaggtaatttatttgttttattttttgaaagtattgggattggtcgggtttggtggtttatatttgtaattttagttttttgggaggcggaggtgggaggatcgtttgagtttcggagttggagattagtttgggtaatatagggaaatttcgttttttaaaaaaaaaaaaagaagaagaaaaaggaaagaaaaatataaaaagtgttgggattataggtgtgagttattgcgtttagtttttttttgtttttttttgtgatttttttaatttttttttttttttgaatttgtttttgggattgtttttgttttttcgtttttttttttttttttattttgtttatttttttttgtatgttttttggtgtgtgtgtttttttcgatgtttttttttttgtttgtttgtttgtttgtatttttttgcgttttttttcgtttttattcgtttgtgtcgtacgcgtatttttatcgggtttttgtttttgttaattgtttttggggttttgtttttattttcgttttagtttttttttataagttttagtttttagttttgaaaattgggtaggcgtttttttattcgtatttttattttttttttacgtatttttcgttcggtcgcggttgtttatcggttaagtttaggcgcgttttggtttagggtcgggcggaagggaattagtttagggttagttaggttgcgtcgggggcgcgcgttcgggaagcgttttttttgtttcgttttcggtttcggtttcggtttcgtttcgtgtttgtagttttttataagtagtcggttttcggtgttagttttagtttgattttagcgtttttattttcggtcgatattttttatggttaatcgttatattatggatttgattgttatttacgaggtgagttttcgtcgtacggtattttcggtatttgtatgtttgagttcgagtttttatttttttagcgtcgtaaattttagttcgggacgtttgttttttttttttaattggggttttttagcgtcgcgttttttagtttggggtttttgtttttcgtttagattagtttggtgatttggaggtgaaaatggaattcgcgatattcggtttttcgtttaaatatgggtggggcggtttatgtaagtggaaagtcggagaattttttttagatcgaggttgtttggaggcggaagtggtttttatatttggtttatttttagtcgttgttgagggcgtggttttgcgcggaggcgtttttggggttgaagttttagggtggggggattcgatttttgtttttttagtttttgatcgtagagatagagaattttaaaatcgaagtaattcggatttttaggttaattttgttcggtttttttagttgtgaaattggagatttcgacgcgtgggttatattcggggaggataagagatttaaaattgggaaatagtggtgcgttttgatttcggggttttttttttggtttagtcggggaagtcgggatttttgggtttttcgggataaggtttcggtggtgggtaaatttagaatttttaattttgggtttttggtattcggaatttaggggtttttgcgggcgggtggggtttaggcggggagtttataaatcggtttggtaagttttagttttttgtagttggggtggggcgtcgttttgtatttttaggtgttttaatcgatttattttcgtaga

SEQ ID NO: 180 - DNA, 5898 bp, Artificial Sequence
  chemically treated genomic DNA (Homo sapiens)
tttgcggaaatgggtcggttaaggtatttgaaaatgtagggcgacgttttattttagttgtagggaattagagtttgttaggtcggtttgtgggtttttcgtttgagttttattcgttcgtagaaatttttgggtttcggatgttaggaatttagagttggaggttttgagtttatttattatcgaggttttatttcgagggatttaggaatttcggttttttcggttggattaagagggggatttcgaagttagggcgtattattgttttttaattttgggttttttgtttttttcggatatgatttacgcgtcgggatttttagttttataattggagaaatcgggtaaagttgatttggaagttcggattgtttcggttttagggttttttgtttttacggttagggattggagagatagaagtcggatttttttattttgagattttagttttagagacgttttcgcgtaaaattacgtttttagtaacgattaggggtgagttaggtatgggggttattttcgtttttaggtagtttcggtttgagaaaagtttttcgattttttatttgtatgggtcgttttatttatgtttgagcgaagagtcgggtgtcgcgggttttatttttatttttaaattattaagttggtttgagcgggaggtaggggttttaggttggagggcgcggcgttagggagttttagttggagaagggaggtaagcgtttcgggttggagtttgcggcgttagagaggtggggattcggatttaggtatgtaggtatcggggatgtcgtgcggcggggatttatttcgtagatggtagttagatttatggtgtaacggttggttatgaggggtgtcggtcgagagtgggagcgttgaagttaggttgaggttggtatcgagagtcggttatttataggaaattgtaagtacggggcggggtcggggtcggggtcgggggcggggtaggaggggcgtttttcggacgcgcgttttcggcgtagtttggttggttttggattggttttttttcgttcggttttgggttaggacgcgtttgagtttggtcggtggatagtcgcgatcgagcggggaatgcgtggggaaggggtgggggtgcggatggggggacgtttgtttagtttttaaagttggagattgaggtttgtagaaggaaattggggcggaggtgggggtagggttttaggggtaattgataagagtagaagttcgatgggggtgcgcgtgcgatatagacggatgggggcggggagagacgtagaggggtatagataggtagataggtagagagaaaaatatcgagagagatatatatattaagagatatatagagagagatagatagggtgaggaagggagggaagacggggagatagagatagttttagagatagatttagagggagaagagggttgggaggattataaaaagaaatagaaaggggttgagcgtagtggtttatatttgtgattttagtattttttgtgttttttttttttttttttttttttttttttttttttgaaagacggggtttttttatgttgtttaggttaatttttagtttcggggtttaagcgatttttttattttcgttttttaaagagttggaattataggtgtgagttattaagttcggttaattttagtatttttagaggatgaggtaggtggattatttgagattaggagtttaagattagtttgggtaatagtgagattttatgtttataaaaaatattatttaaaaaaattaaaaagaaaaagaaattggataaaaaggagaaagattgtgagaaataagtatttacggaaagaaatttgtagagtaaagtgttaagaaagagttagtaggttttggaggggaattttttgagaattgtttgttttgtgtggttttatttttaaatagtttagatagataaggagatttggattgttttttttttttttatttgttggggttgggtgggtgagtgagtgggttgggtggggtttaggatatttggtaaggttgaaaaggggtttttttttttaatttatagggcggttttagtttttttattttcgggcggatgattttttttaggttgagttaaggagaatttatttgggttgagttttaagtattttacgtatattaattttaatgttaggtggtatgtttatttaaggtaggaggaaattaaagtgaagttatttttttgttcggtttatatttgtagttttagtattttgggcgtttaaggtaggcggattattagagttcggagtttgagattagtttgggtaatacggcgaatttttatttttataaaaatgtaaaaattagttgagtgtggtggcgtatattttgtggtttcgttattcgggggcggggagggagtaggttggggtgggagagtcgtttgaatttaggaggtagaggttgtaatgagtcgagattaggcgattgtattttagtttgggttatagagcgagatttttttttagggggaaaaataaagttatttttttagttcgagttagtaaatggtataggttttatattagggtttgaaattatgtcgaggtttgttttttgagaaaatttaagattggtaaggtggaggttttttattataattgatggttgtattgattgaaaaaagtttttaaaaaaaaaaaaaaggttatttttagttgatggttggatgggttttttatagtggggtgtgtttttagattatattttttttttttttttttgagacggagtcgcgttttttcgtttaggttggagtgtaatggcgcgatgtcggtttattgtaagttttatttttcgggtttacgtatttttttgttttagtttttcgagtagttgggattataggtatttattattacgtttggttaattttttgtatttttagtagagacggggttttatcgtgttagttagggtggtttcgattttttgattttcgtgattaattcgtttcggttttttaaagtggtgggattataggtgtgagttattaagtcggtcgggttttttttttttttttttttttgagatggagtttcgtttttgttgtttaggttggagtgtaatggcgcggttttagtttattgtagtttttgtttttcgggtttacgtgatttttttgttttagtttttcgagtagttgggattataggcgtcggttattacgtttagttaatttttgtatttttagtagagacgggggttttattatgttagttaggttggttacgaatttttgattttaggtgatttatttgtttcggttttttaaagtgttgggattataggtgtgagttatcgtatttcgtttagattatatttttaaggattattttttatattggtatattttttgttattaaagggtcgttttaagtgaaaatttttttaagatttaggaagattattttttaaggggtgttggagagttggatgttttgagtgaaaatgtgggggtagaaattattgttatagtgcgtagttataatggtggaaagtttatttttgtaggttgcgggtttgtattaaggtggggagattttgttaggttttacgtcgatttgtttcgttcgagagcggcgggggggaatttttggtgcggcgtttgttgaggggttttttcgggtcggtttcgtgagttgggcgggtcgcgggcggttttggtacggttgtggttttttgttcgttcgtgatttattcgtaaggggcgggggagtgggggttttttggaagtcgtgacgaggaggtttagttcggatattcgggttttttttttgtaattagggttttcgttttttgtaaatagagttttgaggataacggggaaaaaggggggaggagggggatttgggattcgtttttaggtcgatttttaaatttttacgtagtttaaaggattgaggcggggaaaggggggttgggggtatttttgggttcgcggagttcggtttagttcgggttgcgattaattttggaggagggattttagtttttattttttggagatcgggagtattttttatttttgagttaggttgtttttttttttttttttatttgttgagttatcggttttaagagttaggatttttgggatagggttatttttaaaggagggggatgttttgttcgtagaaggattggttttttatttttttaaatttatagatttgggggatttaggagttaaggttttagttttttttttttcgtagtaatttagggttttgggtttttagtttttttttttttagatttaggattttaggtttttagtatttttttttttcggatttaggggtttaggtttttagttttttttttttcggaattaggggtttaggtttttagtttttttttttttagatttaggggtttaggtttttaatttttttttttttagattcgggagatttttaatttttttttttttagatttaggggtttaggtttttagtttttttttttttagatttttaggtttttcgagattttagtttttttttttttagatttaggggtttaggtttttattttttttttttttagatttagcggtttaggtttttaatttttttttttttagattcgggagatttttagtttgttttcgattagatttaggagattaggtttttagttttttttttagatttcgggcgttttaggttagaaggaagtttatggtaggatttttttttgttttttacgtagttagcgggaaaattcgcggttttagcggcggtcgggaattttttttggaatgacggtggggaaggggatggtcggggttttttcgcggggcgttggggttagttttgggcgggcggggaaagaaggaaaggggcggaaattagagaggttaaaaatatagttaatattttcggtttagggggaggggaggggagagtagagtttttagaaaaataagcggggacgggaaacgcgggggtgtgagagttggtcgagtgcgcgggcgagttggggatcgtgtattcgcggtacgtgtgttcgcgtcgtgtgtgcgtttggcgcgattgtttgggtttgagcgggcgtggttaagggcggcgttggtcgtgtgtattttggtttgcgattgcgtgggcggcgggtttgggttagtcgttatgtgtattcggttgtgtgaatagtatgtgtgtttgcgggtgtaaaggtgtgcgttttggtatttggggttgcgagagtttgtgtgtttgggtatgtagtgggggaacgtgagggatacgagtgtgtttagttttttgtgagaaggttgtgtgtatataatttcgtatgatttggttgtgtgaattaatgtgtgaaatcgtttgtgtgatcgattgtatcgtgtgtattttggttatttttgggtgtggggtggatgttttgttgtaattgtattgtaatttgtttttgaggcggtatttttaagaatatgagatttttatttttatttgtatatttgtgcgtagttttgagttattgtgggatttgtagtgattaagtgtgtgtaatttcgcgtaggtgtttgggtgagggaatgattgtttttttttgtgattgaggttgtgtgtatatataattttgtgtgtgtgtgttgttttgagatagggtttcgttttgttgtttaggttggagtgtagtttcgattttttaggttgaatcgatttttttattttagttttttaggtagttgggattaaaggtacgtgttattatattcggtatatatatttgaagttgtgttagtatttgtgattttgtagttgtggtcgtgtgtaaggtttttgtggtttagtgtgtgtagtttttgggtgtgtgaagtgtttatatatgt

SEQ ID NO: 181 - DNA, 4057 bp, Artificial Sequence
  chemically treated genomic DNA (Homo sapiens)
gattatattattgtattttagtttgggcgatatagtaagatttagttttaaaaaaaaaaaaaaaaaaaaaaaaaaaaaaaaaaaatatatatatggatgtttattttttattttgttttatatttggtattttttgtgtattttttaatttaagtatatagtagtaagtgttttatatttttgggtagttatatagaattttattgtggtttattgtggatatattattgaaaattttgtatgtaggttatttagtataaggaggaatataattgttgaagaagtatttaaaaattgaattatttgaataaagtgtgggatatttgttgttttgatggattttattatattgtttttttatttatgtttattagtaatatataggaatatttgggtttttgtagttagggtgtggaaatggtagatgagtttagttttaaggtgtattttttttattaggaggagatggagtgtattttatgggatataagtattagttatattttttgttttgtttatattttttgtttatgtgtttatgaggttattgattttttttattgatttattgtagttttttatttaggaggttaattagttttttgtttgtggagagttttttggtttgttatttgtttttttttaattttttttgttttttggttatttgttttttgattttgatgtggtttttgttgattttttttgatgtattttagtttatttgatttttttttggcgatttatggatttttttttattattaaaagtttttattgtttttttagtttttttgatttaattttttttaggttttcgttttttttaggttttgatttttagttggagttgttggtgtttttttttttatttagcgtttgacgttggagtgtttatagtgtggttgggatttattttttttttttgtagatatttatttttgtgttgattatttgtaggttcgggttttgtgtgttatgtgtatgttttagagtttttgtttacgtttttttatagtttttatgaagtttgtgttttttagatgttttatagatattataagtaaggtatatttaaattttagattattatttaggagtttgtattttttttttgttggttttatttttagttttcgagatttatttatttttttgtatttgttgagattattattttttatttagataatgtttttacgtttgttttatagtttttttaaaaacgattttttttaatttaaattagatttagaaagtttttttatatagtttagtttttttttttgtgttgggttttgttttattattattttattagggaagtttgtatagatagaatttttatttttgtatttgtcgttttcgtttgtttttttggttagttttaggtttttgtagtttatattgtgtttttagggatgaagtgggtttcggtacggtgggtattttgttatgaatgaatggtttttttgtgtatgtagggttcgcgttgtagttaggtagtattttcgtaggtttaggtagtgtaagtttttatttttacgttttttgggatttcggtatggttggtttttttggttagatttaattattttttcgcgaaggtggttttgcgtatgcgtttttgttttttagcgatttgaggagtgaataggattttacggacgaggatttttgtcggggtgtgggttttgttttgattattattcgttggcgtttttttaggggtcggagtcggggtcgttttagtattgggggcggggtggttaggggcggtcgttgcgatgtatgtggtaaggtgtttagttaacgtagtaatttgttgaggtattagaagatttatacgggtgagcgattattcgtgtgtagcgagtgcggtcgtagttttagtcgtagttcgtatttgttgcgttattagtttacgtatatcgaggagcggtcgttcgtgtgcggcgattgtggttagggtttcgtgcgtagcgcgcgtttggaagagtatcggagagtgtatacgggcgaatagttttttcgttgcgttgagtgcggttagagttttcggtagcgttttaatttgttgtagtattagcgtatttacggcgatttttcgggttttggcgttaagttttcggttttttttggtgcgttcgagtttttcggttttttttcgtgtagcgagtgtcgcgagagtttcgcgcggcgcgtcgtgttgttggagtattaggcggtatatacgggcgataagttttttggttgcgtcgagtgcggcgagcgtttcggtcgtcgtttagtgttgttgtagtatcggcgcgtgtatagtggcgagcggtttttcgtttgtgtcgagtgcggttagagttttcggtagcgttttaatttgacgtagtatcggcgtatttatatcggggagcggtttttcgtttgcgtcgagtgtggtaaggtttttcgttagcggtttacgtttacgtagtattttcgcgtatatacgggcgagaaattttttgtttgtttcgagtgtggttagcgttttagttagcgttttaagtttacgcgttattagaggatatatatcggcgaaaagttttattattgcggtgagtgcggtttgggttttacgtaggtttcgcggtttatcgagtattagcgtatttatacgggcgaacggtttttcgtttgtttcgagtgcggttagagttttcggtagtacgttaattttatttagtatcggcgtatttatacgggtgaacggttttacgtatgttttgagtgtggtaaggtttttcgttagcggtttacgtttacgtagtatttgcgtatttatcgacgagagaagtttttcgtttgttaggattgtggtcgtcgtttttattagagtattaagtttatttagtattagcgcgtttatagcgtcgagtagttttagtcgggacgtattgtgttcgttatggttagaatatttattttttttggttattgtgaggttggcgattatataagtataagtaggttcgtttagggtttggttattgtaggtgtttaataaatagtagatggaaattgggtttttatttatttagtgtttttttatttgtgcgttttttattttttattttttagtttttcgagtgttgggttggtgtgttttttttgtaattacgtggtttttgtgagggtttatttttataatatttttttttattttgagagaggtggtttttagtattatttatttcgcgtgtgggatggtcgttatatttagtttttagtttatagagggaatggattagtagtaggtggggtagaattgttttgggtagtttagttttagttttttttgggtaatggatttcggttttttaaatttagagaggaagaaatgttttttgtgagtatttattaagagtatatatgtgtatagtatggtgttatgtttgatttgattgagttttattaagagatagagtatagttaattaggtgttaggtgattgatgggagagtgagaaggttaagttaatttgttttagaaatgggaaagtttttgtaggaagtagttagatttttaggattagaggaataaagggaagtattgtaatttagaagttttaatgagttttttatggagttggaatttaggtttttgagaagagggtattgttgagttagttttggggttttttagttggtagggaagttttgtgggtttgagggggtattgtttagttggtttggaggtttttgtttttaagagggtgttttataggtttaggagatttttgagggggtattggtgtgggtgtttttaaggggtttagtgagtttggttttgggaggtatgtaaaaattgttgtttttggaaggatttgttgttgttaaggggaagaggtggtgttggtttagttttttttttttttttaatttttgttttagtttgtttttaatagatttgtaagtgaagagaggtgtttgtagtttttgttttgtatagtgatgtttaggtgggtaggtttggagtttagttttgtttggtgatgaaattttatgggatttttttttgat

SEQ ID NO: 182 - DNA, 4057 bp, Artificial Sequence
  chemically treated genomic DNA (Homo sapiens)
gttaagggaaaattttatgggattttattattagataaggttgggttttagatttatttatttaggtattattgtgtagggtagagattataaatatttttttttatttgtagatttgttaagggtaggttggaataggggttggaaagggagaagagattaggttagtattattttttttttttggtaatagtaggtttttttaggagtaatagtttttatatattttttagaattaggtttattgggttttttggagatatttatattagtgtttttttaggagttttttaggtttatggggtatttttttgagaatagagatttttagattagttgagtagtatttttttaggtttatagggtttttttgttagttaagagattttaggattggtttagtagtgttttttttttaggggtttgagttttagttttatgggaaatttattggagtttttaagttgtaatgtttttttttgtttttttagttttaagggtttagttgttttttgtaggaatttttttatttttaagatagattgatttaatttttttatttttttattaattatttaatatttagttagttgtgttttgttttttgatgggatttaattagattaggtatggtattatgttatgtatatatgtatttttggtggatgtttatagagaatatttttttttttttgggtttgagaaatcgaggtttattgtttagggagagttgaagttggattgtttagggtagttttgttttatttgttgttggtttattttttttgtaaattagaagttgggtatagcggttattttatacgcggggtaggtgatgttaggagttattttttttagggtgaagaggggtgttgtggaggtgaatttttataggaattacgtggttatagagggagtatattagtttagtattcggggggttggagggtggggagtgaaggacgtataggtagggaggtattgagtgggtggagatttagtttttatttattgtttattggatatttatagtagttaagttttgggcggatttgtttatatttatgtaatcgttagttttataataattaggggaggtaggtgttttgattatggcggatatagtgcgtttcggttggagttattcggcgttgtggacgcgttggtgttgaatgagtttggtgttttggtggaagcggcggttatagttttggtaggcgaagggtttttttcgtcggtgggtgcgtagatgttgcgtgagcgtgggtcgttggcggaaggttttgttatatttagggtatgcgtagggtcgtttattcgtgtggatgcgtcggtgttgggtgaggttggcgtgttgtcgaaagttttggtcgtattcggggtaggcgaagggtcgttcgttcgtgtggatgcgttggtgttcggtgagtcgcgagatttgcgtgaagtttaggtcgtatttatcgtagtggtagggtttttcgtcggtgtgtgttttttgatgacgcgtgagtttgaggcgttggttgaagcgttggttatattcggggtaggtaaagggtttttcgttcgtgtgtacgcggagatgttgcgtgagcgtaggtcgttggcggaaggttttgttatattcggcgtaggcgaagggtcgtttttcggtgtggatgcgtcggtgttgcgttaggttggagcgttgtcggaagttttggtcgtattcggtataggcgaagggtcgttcgttattgtgtacgcgtcggtgttgtagtagtattgagcggcggtcgaagcgttcgtcgtattcgacgtagttaaaggatttgtcgttcgtgtgtatcgtttggtgttttagtagtacggcgcgtcgcgcgaagttttcgcggtattcgttgtacggaaaggggtcgggaggttcgggcgtattaggaggggtcgggggtttagcgttagggttcgggggatcgtcgtggatgcgttggtgttgtagtagattggagcgttgtcggaagttttggtcgtatttagcgtaacggaaaggttgttcgttcgtgtgtatttttcgatgtttttttaggcgcgcgttgcgtacgaagttttggttatagtcgtcgtatacgaacggtcgtttttcggtgtgcgtaagttggtggcgtagtaggtgcgagttgcggttgaagttgcggtcgtattcgttgtatacgaatggtcgtttattcgtgtggattttttggtgttttagtaggttgttgcgttggttgaatattttgttatatatatcgtaacggtcgtttttaattatttcgtttttagtgttggggcggtttcggtttcggtttttgggggagcgttagcgggtggtgattagagtagggtttatatttcggtagggattttcgttcgtggggttttgtttattttttagatcgttggggagtagaagcgtatgcgtaaagttattttcgcgggagggtgattggatttggttagaaaggttagttatgtcgaggttttaggggacgtggaggtgagggtttatattatttggatttgcggagatgttgtttagttgtagcgcgaattttgtatatataaggggattatttatttatgatagaatgtttatcgtgtcgggatttattttatttttggggatatagtgtgaattatagggatttgaaattgattaaagaggtagacggaggcgataaatgtaggggtagggattttatttgtatagatttttttgatgaggtgataatgagatagaatttagtataaggaggaagattgggttatgtgaaaaagttttttaggtttgatttaggttggaaaaaatcgtttttggaagggttgtagggtaagcgtgggggtattgtttaggtggaaaatgatggttttagtaaatgtagggaagtgggtgggtttcggaggttggaggtggagttaatagaaagagggtgtaggtttttggatagtggtttggggtttggatgtgttttgtttgtgatgtttgtggggtatttgaggaatatagattttatgaaggttgtggggaaacgtgagtaagggttttagggtatatatatggtatatagaattcgggtttgtaagtgattaatataggggtgggtatttatagaggagagaagtgggttttagttatattgtgagtattttagcgttagacgttgggtgaaggaggaggtattagtaattttaattgagaattagggtttggagaaggcggaagtttggaggaggttaaattaagaagattgagagagtagtgagggtttttagtggtgagagaaagtttataagtcgttaaagaaaagttagataaattagaatatattaaaggaaattagtaaaaattatattagagttaaaagataaatggttaaaaaataaaaaaaattaaaaaaggataaatggtaaattaaaaaattttttataggtaaaaggttaattaattttttaagtaaagagttataataaattagtaagaaagattaataattttatagatatatgggtaaaggatgtgaataggataggaaatgtagttaatgtttatattttataaaatatattttatttttttttagtaagaaaaatgtattttagggttgaatttatttgttatttttatattttgattgtagggatttaagtgtttttatgtattgttggtaagtataaatgggaagatagtgtggtaaaatttattaaaatagtaaatgttttatattttgtttaagtaatttaatttttaggtatttttttaatagttgtgtttttttttgtattaagtgatttatatataaggtttttaatggtgtgtttatagtgagttatagtggggttttgtgtagttatttaaagatgtagagtatttgttgttgtgtatttaagttggaagatgtataaaaaatgttagatgtggaatagggtggagaataagtatttatgtgtgtgttttttttttttttttttttttttttttttttttttgagattgagttttgttgtgtcgtttaggttggagtgtagtggtgtgatt

SEQ ID NO: 183 - DNA, 6203 bp, Artificial Sequence
  chemically treated genomic DNA (Homo sapiens)
attttaattttggtatttaaaaagttaataaaggagtaagttattttgtttatgttatatattttataattttggatatgtggtttttagtttatttttatttaaggatatttatttagtattttatttagtaaagtatattataattaaggatttataaaatgttgttttagatttcggaaaagtaatattttttttaaagaatatgaaattttaaaaatgagaaattaaatagtaataaaaattttttggttaatgttaattatgtggaatttttcgttagttatgtgttgagattattaattgtttggttattgttttagtattattaagtagagataaagttagtttatttaaataaagtgatattgtaaatttaattatgttgataataaattattaaaaaggtatttttggattatttatacgttttttaaaaaatgaattggtaagattgttgtaattttttatttattgtgtatttttgtaaagtaataaagtatgattttattcgaaatttaaatttttaatgtttaatattttattataaattgggtaagattttttttcgaatagtatgtttgatggtataatacgatagaatagtatatttaatggtataattagtagtaaaaaaataaaaaatttgtttgacgtgttttcggaaaacgtaaaatagattgtatatatagtaattttttttataagataatgataaaatgttagagttgtaattgaggattttattaattgaattatatttttgattataatattttgtgtatgttaatagtttttttggagaaattacgggtataggaagttttttttattaaggatattaatataaagtttaatatgaaaaattagtatttagtttagaaatgacgattttagaaatgattttagaaatgacgatttgtatgatttttttattttttataatttagtattaaaattatttaatattgtaaaggatggtagtgttttatttcgttttgttatttaattattgttgatagatatatgtttttaaaaaggttattggtatttgtttgtttttttttatttttttaagtgaatatattttttaatatgtagtaaatatatatgtggagttatgttttgagatttttttgaaggatttgaattaaattgtttaaatagttggtagtttaaaattggaatattttttataagggaaaaataattatttggggaatgtatgttattataaatttatttgatttggaaagtgcgtttttatattaaattaaataattgaataatgggattagaaatttttaattattattaatttcggttatcgggcgtcgtggtttacgtttgtaattttagtattttggaaggtagtggtaggtggatcgttcgagtttaggagtttaatattaatttagtaatatgataaaatttcgtttttataaatataaataaaaaataaaaattattaattttgagtgagttaagtttatttgtagattgaaaaaaataaagtgtaatagaattttgatttaaaaaacgtttttaaaaaagtattttaaaatgttttaagtatgttttaaaaatatatttaaaaatatgtttttaatatattgaagggatttaattaagatttataattatagttacgatataaattgtaagttaaaaggtagtaatttaagttgagatagttattaatatttttcgagtagcgttttttgttgcgattcggcgtcgtattcgttatttcgtttttcggggaggaatttagaaaggaagggtggtatatttttaaattaggttatttatatatgaattaagcggtattataggttgttaataatcgggtttttatttttttttttttttcggcgtttcgttcgtgcgggatattagtttttaggatgcgttaatcgtagatcgtttaagcgtaagaggtggcgagaggttattacggttgtttaatagttgcgtttttaggttgtttggtgtgacgtagtagttttcgttcggattttgaggtttggcgtttcgattgagtcgaggtttgtgttattcgatattttttgcgattcggttttttaggtttatttagcgcggtttttttcggtttttcgagttttatcgtagtttttttttattttcgttttttttcggttttttgttagtgttcgtcgcgatgtttttgcgtaattattttaagtgatattagcgtttatattcgtacggagcgagtttgaagtttttatttttcggaatttaacgtcgggtcgttaagggcgggtatttaagcgaggattagcggattaaggtcgcgattagagtttagcggttttcgcgtagttagagttcgatagtttttgcgtattcgtcgtgcgtatttttattcgtgcgcgtgcgcgtattcgtttttttcgtttcgttttagtattaatcgttttttttttacgtttacgattttttaacgtagtttttttcgtttttcgcgcgcgagtagaaaggtttcggcgtgcgcgcgttcgttcgtttcgcgttttgtcgggaaggggagtgagtagaggcgtttacgtcgcgcgggaggcggaggcgacggcgatttcggtggcggcggcggttacgacggagacggttgttgttcgtttgttttttcggcgttatggcggttgtcgggggtagataagcggagggagcgggagcgcgcgcgcgacggcggcggcggcggcggcgacgattggttatttatagtttttgttgttttcgatttttggtgttttaataatgaatgttagttttatttcgtaggggatcgcgcgttggtgttgcggatcggggtttttttttttttttcgcgtttgtttttttttttttttttcgtacggatttttgtttatttcgagacgtcggagttttaggattgggcggcggagatttcgggtttgggcgcgggggaggtcgtttattcgagtcggtttttttcgtttcgttaagttcgtcggtaagaaagggggcggcgggcgggttaggatgtggcggagaggataggaatcggtcgggcggagggcgggcgcggcgcggtgtttaggcggcggtttagcggtcgggtgaaggtcgggtggttttgtgagtgtcggtggcggtgtacgggtttggcgcgtagggggcgtgtgagcggcgagtataggtcggggtcgtagaacgtatttttgcgtcggttcggcggttttgtttcggttttttcggtttggtgtcgatcgggtcgcgagaggagattcgcgaatggttagtatttagtcggtgcgtgggttttgtcgcgattcgggtttttagtacgtggggagcggcgggagggggagggggcggcggttcgggcgagtttgggagggcgcggggcgggtttgcgggaagtttgaggcgggaagagggatttttggatcgggatggaggttttgggagaggggggtaggttcgcgagggaggttgattggagcgcgttggatggatgagtgaggatggtttttaaatttttttcgagtgtcgttttaaaaatttagtaggagtaaagtaattgttaaaagatagaggattgaagaggtttaataatttagggtagttattgtggagacgtttgagaggatatagcgttgtgtgcgtttggagttttagaatttagggttgtgaaaagggttttagaggatttattcggataagggagatggaggggaaaggaagttaaaatgtatagagaaagttattttgagggacgaaaggaaggtgaaaaggaaagaacgaaaaggggagtgaattttttaaaggaagaaacgggaaaggtagtttgttaatatatttagattttttaagatttaattgtttagtaaggtattttgattagggttgagattaatatttaatattaggaataaatgttgagtagaacggttattttttagataatttgtttttgtagagtttattggatagtagtttagagaattaatattttgatttagatgtagattttgttattattgagttggtaataatttgttttttttttttttttgtggaatggaaataatcgtaggagtgaattttttttgttgaggtcggaggatagttttgtttttagttggttgtttcggtattttttggttggggaaggatttgacgtttttttttttcgttttttttttttttttttttgttagagattttttttgtttattcgtggatggtttgtaggtgattttttagtgttgtattgaaatttttaaaggtggaaatggtgtgttttggtttattatttttgttttaaattttttacgtaaaaaattagatatagtgtatattttattatttttttaattttttttataaaataaaaattaagtgtaaattggttaagtattatttaaatgttattattttattattcgtttatttgttaaataatatatttattttgagttatgtatttttgttgagagtatatggtattttttatttgtttgttttttttatgggagcgtttttagaatttttttatttaagtgtatgaagtttttggtgataggagtgagggtttgattaaaggtaatttttttttatttttttttttattttatttattcgattaagttatttaataagatttcgttatttatttttgggatgtatgtatatgttatatcgtattattttgttttaggagtttataaaaatattgttagttgtagttagtttttaaaaatttttttattttataaatattttaattttttttgttcgaagtatattagtagtagtatattaaattttagttagtagttaggagtgtagttattataagtttagatattttaagtatttaataaaaggtttttattttttttttaatagttgtagtttaattggtttacgtagatttatacgttttagatagggtttaatttattttttttttgtaggaaattttgttaatttattaatatattttttttaggtgaattaaaggagagttttagaaaatttgtgattgttgaagaaaatttatttgtgaatttttatatttaaggagttagtatttatatttattttttaaattgggaagatttatattttattttaaaattttttgataataatttataatgaatggatatagtgatgaagaaagtgttagaaatagtagtggagaattaaggtaagtaagtattttgttattaattgtttattatgaagagagttgaaaatttgatttttttttttattgttattgttgttatttagttttttttataggtagtagagtttttaggttttttttttagttatttaaatattaaaaaaattttgatatacgaatttttttttataatataggttttaattatattttttatttagatatatagtagattttaaatatagaaagtttttgtttatttaaatttatttggaagtttatatttgagttaataattaagttggagtatgtataatagatttaaattgttttgattgttagtgaaatttttagatgaaggtaataaaaatttttttatttatttttttttggtattttgttttttatatttgtattgtttagtgtggtaattattagttatatgtggttatttgaatttaattataaaatatttagaatttatttagttatattagatatattttaagtgttgaataattatatgtggttagtggttattatattggatagtatatagaaaatattttattattggagaaagttttagatagtgttgagttagatatttgttgaaatattattgtggtttttttttatttttagattggagttttaattatttgtgaaggagttaagagtttttgtttgggttaagtgtttgtaaagaagattttttaaattttgtagtttttaaattttgagttatttgtatattagtttataatttatgtagttatatgtattattatatatagaaattaggaatgtgggtattggagttaaattgtttgtttattttatttttattttttattagttgtgtgaattagggtaaattatttaatttttgaggttttgatttttgttttataaagaggggattaaattattgtttattttatttaaagtttacggttgggtttgttggattttgtttgtaattttagtattttgagaggttgaggaaggaggatta

SEQ ID NO: 184 - DNA, 6203 bp, Artificial Sequence
  chemically treated genomic DNA (Homo sapiens)
tgattttttttttttagttttttaaagtgttgggattataaataggatttaataagtttagtcgtgaattttaaataagataaataatagtttaattttttttttatggggtaaaaattagagttttagagattaagtaatttgttttaatttatataattaataagaggtagaaatagggtaagtaaatagtttgattttagtgtttatatttttaatttttatatatgataatgtatataattatatggattgtaaattaatgtgtagataatttaaaatttgagagttatagaatttaaagaattttttttgtaaatatttgatttaagtaagaatttttaatttttttatagataattaaaattttaatttgaaaataaaaaagggttatagtaatattttaataaatgtttggtttagtattgtttaaaattttttttagtgatagaatgttttttatgtgttgtttaatatggtagttattagttatatgtgattatttagtatttgaaatatatttagtatgattaagtaaattttgaatattttgtaattgagtttaaatagttatatgtggttagtggttattatattggatagtataggtatagaagataaaatgttagaaaaagatgagtgaaaaaatttttattgtttttatttagaaattttattaatagttaaaataatttaaatttattatatatgttttagtttaattattagtttaaatataaatttttaaatagatttaagtaaataaaaattttttatatttaagatttattgtgtatttgaatgaaaaatataattaaaatttgtattatgaaaaaaggttcgtatattagaatttttttagtatttggatagttaagaggaaaatttgaaaattttgttatttatgaggaaaattaaataataataataataataaagaaaaaagttaagtttttaattttttttatagtaaataattgataataaagtgtttatttattttgattttttattattgtttttaatattttttttattattgtgtttatttattgtaaattattattaagaagttttaaagtaaaatataaatttttttagtttaaaagatgaatataaatattgattttttgaatataaaaatttatagatgaattttttttaatagttataggttttttgggatttttttttgatttatttaaagaaaatatattaataaattaataaaattttttgtagaaaaaaggtaaattaagttttgtttaaaacgtataaatttacgtaggttaattagattatagttgttaaggaagaagtgggggttttttattaaatatttaaaatatttagatttgtaataattatatttttgattgttaattagaatttagtatgttattgttaatatatttcggatagaaaaaattaaaatatttgtggagtgaaaggatttttagagattaattgtaattaataatgtttttatagatttttaaagtaaggtgatacgatgtaatatatgtatatattttaagagtagataacggagttttattagataatttggtcgaataaatgaagtgggggggggggtgggaggaggttatttttaattaagtttttatttttattattaagaattttatatatttgagtgagaaagttttgaaaacgtttttatgggaggaataggtaaataaaagatattatatatttttaataaaaatgtatagtttaaaataaatgtgttatttaataggtaaacggatagtgggatgataatatttaaataatatttaattagtttgtatttggtttttattttgtgaaaaaaattgaaaaggtaatagaatatatattatatttgattttttacgtaaaaaatttggggtaagaataatgaattaagatatattatttttatttttaaagattttagtataatattgaagaattatttataagttatttacgaataaataaaggagatttttggtaggggagggagaggaagaagcgggggaaggagacgttagatttttttttagttagaaagtatcgagatagttaattgagagtagagttgtttttcgattttagtaaagagaatttatttttacgattatttttattttataagagagggagggaaatagattgttattaatttaatgatagtaaagtttgtatttggattaggatgttaattttttagattattgtttagtagattttgtaagaataggttatttaaaaagtaatcgttttatttaatatttatttttaatgttaaatattaattttaattttagttaaagtgttttattgaataattaagttttaaaaaatttaagtatgttaataaattgtttttttcgtttttttttttaaaaagtttattttttttttcgtttttttttttttatttttttttcgttttttaaaatggttttttttgtatattttaatttttttttttttttattttttttattcgaataagttttttgagattttttttataattttgagttttgaagttttaagcgtatatagcgttgtgtttttttaagcgtttttataatgattattttaagttattaaatttttttaattttttgttttttagtagttgttttgtttttgttaagtttttaaagcggtattcgaaagaggtttggaaattatttttatttatttatttagcgcgttttaattagtttttttcgcggatttgttttttttttttagggtttttatttcggtttaggagttttttttttcgttttaaatttttcgtagattcgtttcgcgtttttttaggttcgttcgagtcgtcgttttttttttttttcgtcgttttttacgtgttgggagttcgggtcgcggtaggatttacgtatcggttaagtgttagttattcgcgggttttttttcgcggttcggtcggtattaagtcgaagaggtcggggtagggtcgtcgggtcggcgtaaggatgcgttttgcggtttcggtttgtattcgtcgtttatacgttttttgcgcgttaggttcgtatatcgttatcggtatttatagagttattcggtttttattcggtcgttgggtcgtcgtttgggtatcgcgtcgcgttcgtttttcgttcggtcggtttttgtttttttcgttatattttgattcgttcgtcgtttttttttttatcggcgggtttggcggggcggagggagtcgattcgggtggacggtttttttcgcgtttaggttcgggattttcgtcgtttagttttagggtttcggcgtttcggggtaagtaagagttcgtgcgggggagggggaaggggatagacgcggaggggaaggggaagtttcggttcgtagtattaacgcgcgattttttgcggagtggagttgatatttattattgaagtattaagggtcgagggtagtaagagttataagtaattagtcgtcgtcgtcgtcgtcgtcgtcgtcgcgcgcgcgttttcgtttttttcgtttatttgttttcggtagtcgttatgacgtcgagaaagtaagcgagtagtaatcgttttcgtcgtagtcgtcgtcgttatcgaggtcgtcgtcgttttcgtttttcgcgcgacgtaagcgtttttgtttattttttttttcgatagagcgcgaggcgggcgggcgcgcgtacgtcgaagtttttttgttcgcgcgcgggaggcgggagggattacgttgaagggtcgtgggcgtaggaaaaaagcgattggtgttggggcggggcggggggggcgagtgcgcgtacgcgtacgaatgggagtgcgtacggcggatgcgtagaggttgtcggattttgattgcgcggagatcgttggattttggtcgcggttttagttcgttgattttcgtttgggtgttcgtttttagcggttcggcgttgaatttcgggaagtgggagttttaggttcgtttcgtgcgggtatgggcgttaatgttatttgggatggttgcgtaaggatatcgcggcggatattgataaggaatcggggaggaacgggggtggggagagattgcgatgggattcgggaagtcgggaagggtcgcgttgaataagtttaaggggtcgggtcgtaaggagtgtcgggtagtataggtttcggtttagtcggagcgttaggttttagggttcgggcgggggttgttgcgttatattaggtagtttgggaacgtaattgttgggtaatcgtggtggtttttcgttattttttacgtttgggcgatttgcgattgacgtattttgggagttgatgtttcgtacgggcggggcgtcggaggaggagagaaaatagagattcggttgttgatagtttgtgatgtcgtttgatttatgtgtgggtggtttggtttagaaatgtattattttttttttttaggttttttttcggagggcggggtgacgggtgcggcgtcgaatcgtaataaaaaacgttgttcgagggatgttagtaattgttttagtttaagttgttgttttttagtttatagtttgtatcgtaattgtaattgtggattttagttaaatttttttagtgtgttggaaatatatttttaagtgtatttttgaaatatatttagagtattttgaaatgtttttttgaaagcgttttttaaattaaaattttgttatattttattttttttagtttgtagatgaatttgatttatttaaggttaatgatttttgttttttatttatgtttgtagaggcggggttttgttatgttgttaggttggtgttgaatttttgagttcgagcgatttatttgttattgttttttaaagtgttggaattataggcgtgagttacggcgttcggtggtcgaggttaataataattaaaagtttttaattttattgtttagttatttgatttggtgtaaaggcgtattttttaagttagatgagtttgtggtaatatatattttttaaataattattttttttttgtgggaaatattttagttttaggttattagttgtttaaatagtttggtttaaattttttaaaaaaattttaaaatataattttatatatgtatttattatatattgaagggtgtatttatttggagaagtaggagaaagtaaatagatgttaatggtttttttgaaaatatgtatttattagtaataattgaatagtaaaacgaagtggaatattattattttttgtaatattagatagttttaatattgggttgtgaggaatgaaaagattatataaatcgttatttttgaagttatttttgaagtcgttatttttgaattgagtgttaattttttatattaagttttatgttaatatttttaatgagaggaattttttgtgttcgtaatttttttagagaaattattaatatatatagaatgttgtaattagaagtatagtttagttaataaagtttttaattataattttgatattttgttattgttttatgaaaagaattattgtatatatagtttattttacgtttttcggaagtacgttaggtaggttttttgtttttttattattaattgtgttattgaatatgttattttgtcgtattgtgttattaaatatgttattcgaaaaaagattttgtttaatttgtaataaaatattgaatattggagatttagatttcgagtaaaattatattttattgttttgtagaagtatatagtaggtggaaaattgtaataattttgttagtttattttttaaaaagcgtgtaggtaatttaaagatatttttttgatgatttgttattaatatagttaaatttgtagtgttattttatttgaataaattagttttatttttatttagtggtattaaaataatagttaaatagttgataattttaatatatgattaacgaaaaattttatataattaatattaattaggaggtttttgttattatttaattttttatttttaaaattttatattttttggaaagaatattattttttcggaatttaagatagtattttgtgggtttttaattgtgatatgttttattaggtaaagtattaaatgggtatttttaggtggggataggttgggaattatatatttagaattgtgaaatatataatataaataggataatttgtttttttgttagttttttggatgttagggttaagat

SEQ ID NO: 185 - DNA, 7657 bp, Artificial Sequence
  chemically treated genomic DNA (Homo sapiens)
tattaggagtataatagaaaacgagggttagggggcgtataaagagatcggacgataaaaacgtaatgattatagaacgtcgggattaggattattgggggggtacgcgtttgtattttattttttgggaggttaaggtaggaggatcgtttgggttttggaatttaagattagtcggagtaatatgggggaattttgtttttttaaaaaaaatataaaattagttagggtatggtgatatgtatttgtggttttatttatttgggaagttgaggtaggaagattagattatttgagtttgggggattgaggttgtagtgagttgaaattgtgttattgtattttagtttgggtgatagaacgagattttgttttaaaaaaaaaaaaaaaaaaaaaaaaagaatttggtttttggagtttattagagtattatacgtcgtatttagtaatgatttatgagtatttgttgttatatgataattttgttttaggtagtatagatatacggaggtgttttttgtttttatgtggtagtttggtggagagataattttagataaggaaatatataagtttagagataataagatgttataatgtatgttatgatgtgaaaaatttgggtattatgagagagaagacgagggaagattttgatggggttaggaggttaggagggtttttttgagggtgtgatatttaagttgagttttgaggttggaggaaggaagagttttgtaggcggagagaatagttgtgttaaggttttgaggggggaatcgaaagttaggtagtgtaagggtagattagtaggggaggaagaggggagtagagtgttatgatttgggaaatgtgagtaggtagaggttatattaagaagtttgttttttgattaataaaagttttggaaagattttaattagagtaggtttgttttttagaaagtgatttttgaggtttaggtatagttttgtgtggaagatagtgtgtgaggttgaaatttagagtgtgttattatttggaaataattttgtaaaggtgagaggtttgttatagttatataattttaattaatgtattttttttttcgtaaattttaagttggttgtgaaatatgacgatggagtattttgtatatgttataaaattattgttaatgtttatttatttttggataaagattagtattagttattggaaatatttgtttgggttacgaggtttgttttttgttaggagtggagatttttttatagattttttgtttttttttgttgtttttgggtgatttagtttatgatatttttgttttttttgaaatttttatattttgttttttttaaattttaaggtagtttttgcgtaatatattattttttattgatttttgttttattagggtttatagtggatggttgtatgggggttatgtgattgaatttttgattttcgttttagtttatttatgtgatatgtatggagttttttagtagggatttattgattaggataagagtttgagattttgaggggatttgattgttattgtataattaaggatagtatttttaagagtggatgttgtttaagatagtttaaggaattttatgaagaaaaggattttatagataataaattttggatattttgttttaatatagttaagcggttttttataattataggattttttagaatatttaatatgttaatgtgtattttaaatttttaagaaagaatgatgtatatttatttttttttttaggtgtattttagagattggtgtttgtaagtatatggagtaggaaattttatttcgaagatggagatttcggggttgttagtaggcgttaggtaagtgttttaaaatttttaatttttagtaagagaagttaattgaaggatgagatagggtttttgttttttttgggttttttagtattatatggaggggttggagtgaattttttggaggtggggttaatgatttttggaggtaggggaaagttttttttgattaagttgtatataaagatagaaaacgtgtttgtatgggtattgtttaatttgtttaaaagaatgaaaagattttagtatttttttttttttttgtaattattaaagaagtatatgtttttgtaaaaaaaaaaaaaaattaaataatatataagtatatagagtaaaaagtggaagttttttttttattttttttttgtatttttttttgtattttggagtgttttatattaaggttttggtatgtttggtttagtgggtgagaagattaatttggagttagtattttgagattgaattttagttttgttatatgttagttttgtttttttgggtataagttttattttgtttatttttaaaataaagtagtcgtaggaagggtttggtaggtatgggatgagatgaaatatagaaagttttaatgtagtatttgaatttagttggatttagttaaatttggtcgttagaattttttttttagaatttaggtattttttaaaaggtttaattttatttaatggatgtgttaattcgagaatggggtttattttttaatttgtttatgtgatttttttttaagtttttaagggtagtttttatgtagaaattattatttagaggtttattttatttttttaagtttatagttaaattgttaaagttggaaattaaaaaaaagtagattatttgattttttttattttatatattagttcgtttttaatgttaggaattaagaatttttttaggattttgatggaatgattattattttagaaaatgttatgtttttataaatatatatgtttattatgtatttgtaaaaattaaaaataaaaattttgttaaaagaaaaaaaaaaagaaaatgttatgtttttaagtttagtttataaaagtttttattttttttataaatttagttagaatttttagataaaataaaagttgtttaattgaatacgaattattttaaatttaaatttatttattgttttatatttttatttgttaaatttgttaattttaaatttaataaatttaaataattatttataaggggtttgtggttaatttataaatattttatattttatttaatatgttttatttttttttaaaagttttttaattgtttgaattaataaaaaagttatttttaaaaaatattaaattatttgaattttaataaagtaaataaataaaatattgatgataatttaaagtgtttataaatgttttagaattgtatttagataaaggttttaacgtaaagttatgaatttgaattaaattttattaagtgtatattttataagagagttataagattttttatatagttggtttagtagtttttattaagtttatgaaatatcgtatattttattttaaaatatataaaaagagtatattatggttttgagttttttaaatatttttatattttaattttaaattttttttttggttggaagatgtttatttattaagaaagataattaattattttttagagtttttttttttttgtttttgtattttattgagatggaattttattttgttgtttaggttggagtgtagtggtgtaattttggtttattgtagtttttgttttttaagtttaagttatttttttgttttagttttttaagtagttgggattataggcgtttattattacgtttggttaatttttgtatttttagtagagatagggttttattatgttggttaggttggttttgaatttttgattttaagtgatttatttattttagttttttaaagtgttggggttataggagtgagttattgcgttcggtttagagttatttttattagagatttaattaggtttgaggttttaggttgtagataatagggagatttattgtagtacgaatttaggaaattatttttttttatgtattatttggggttattttatagaatttttggtatgtttgggttagtatgttgtttggatgtatgttggggatatatgtataattttttttgtggttgtggttatagatttattattataagaggggttggtttatagatttcgatgttggtttggagttatttttattttttattttttttatagaattgtttttgttaaagtttattaatatattttgattggattttgtttttttttttaatttttttttgttttatagatttttatagttttttgtttatatttttaaaagttattttgtttgagttgatattttatagtttttataagattttttttttttagggttatataattttcgttaatattaaattaatattagttttaattacgggtttttttatgggttttacgggttatttgttcgtagagtttagggatattttttttatttattttattagatttttaattgttttttttggtaatatatttttagtatttgtacggtaaagttgtttaaaaaaattaagtaatttaaattatttttgattttattttatattattagggtaattagagttatagtttgggtgtgtttgaggatagtaggtcgttaaattttagtgatttagagaaaatcgagtagaattttttatgttttttgttttattgttttttagtagaaggtttcgttattttaggtgttttttagggtggattattttcgagtttatttattgttaggaaaaggtatatggtatgtaatcgtaagatcgatgattagatgttagagttggttttcggttgggatatgagtgattttgtggaggatggcgtttaaatgaggtatgttaatttttgtattagggtgacgaatataagggttttttaaaggttagtttaatgtatttgtatttttttggggattaaaatttatgatttttagttttttagagaattgaaagttgtaaggagaaatttagtaatttttgttatttgtaggttttataagttagtggagtttgcggaagtggttagaatttagtattttaagtattgttgtttttttatagagttttgaagttagagtagcgttaggatgttacgggagttggttttattgttgtttttttttttttttatttatagcgttttggttatgaggatttgtttttttaacgttaggttttttggggaaagtaagtaggaagataagaatgttatggatgttattgtgaaggtgagttttttttttgggaggaggattttagatattttttatatttttttttttgtttgtagattttaagagatttaaggaatttaaagttggtttttagggggaatgtagaagttggtttggaataataattattttaattttttgtattttttgtcgttattttaaaataggggtgataataatggttttttttagggttgttggggggattataggagttggtaaatggaaagtttttaatgtagtatttggtttattatacgttttagataagggttagttattatgatttttattgttatttattgaatgtttgtattaggtattataagtatatggttttattttataatttttatgaagagggattattattttttatgtagaggtgatgaataaagaaagatgaagtaattttatatagttatttttttttattagtaaagtttagttttttttttttttttttttttttttttttttttttttttttttttttttttttttttttttttttttttttttttttttttttttttttttttttttttttttttttttgtttttttttttttttttttttttttttttttttgttttttttttttttttttttttttattttttttttttttttttttttttttttatttttattatttttttttttttttgttttttttttttttttttttttttttttttttttttttttttttttatttttttattttttttattttcgtttacgttttttttgggtgatatatttaatgttcggggatattgtttgttttttttggagttaattgattttttttattttataggttaattaatttttgatgttggtaatttaatttttttttaggattttggaaaggtatttattattttaggaaatttgagatattatggtgtggtaggggggttaggagttttgggtttagattttatttattagatttgtgagtttgggaggttttgtttttttttgaattattagtttttttagtaaaatggcgattatatttaaatattatttgtagtattggttggtgaagagaatttagggtgtttgaggtatttagtagagtttgtagtaaggtgggtatttatgagttagagtcgttgttgttgttgttattgggaaggaggattggagtgaggattggtaggttttgtttttttttggacgagttttttagatttaggtggttttgttttttgggaggtaattaaggttttttagatggtgttgtttagttaggatagtaatgttaagtttgtgggagttatgataagattgtttaatgggaaattttgatatgtaaggtaatgattttttttattttatatatggttcgtggagtttgggtagttattgagtttttatttttttttttattgatgaaattcggttgtttttttgttttttggtgagtttattatgggggtttgaattttgtattttttttgagtagttgtgttttgtagagtatgttcgaagtttttgttaaggttgttttattttttttattttattaagaggttatttttaaaatattgtaagagttattttatagggtatttatagttattcgagaatgttaggtatttagaataggattatttttagcgtttattgattaagtattttttataggtgttaatttttgtatttttagtagaggcgggttttattatgttggttaggttggtttcgaatttttgattttaggtgatttgtttattttggttttttaaagtgttggtattataggcgtaagttatcgtgttcggttgggattgtattttaatagtttaatatggtgggttttgtagttacgtagatttaagtttaaattttgattttattatttattttggttgtatgattttaagttagttatttaattattttgagtttggtttttgtttatgtttaatgggttaataagtatagttattttatagggttgttgtaaggttcggagtaggtttgtagtaaatgttagtttttataattattattattataattatatttttttatttttaatttagtttgttatttttgtttattaagggtttaataaatatttattattattattgtaattatttaagtaaagttaagaggtaggatattgtggggaggttatgagtaaggggttttgggtttgaattatataggtttaaattttgttttcgttattttttagtagggtgattgggagtgtaatttatttaattttttttgagttttacgtttttttttaaaatgtatataataaaagtatttatttattttagggagttttttatttagtttagagaagaaattattttaataagtatttagtgtaatatttaaaaatagtaagtgtttaataaaaggttttatttatttgtggtaaatgattttaaatttttgggaatttttttttttgtagg

SEQ ID NO: 186 - DNA, 7657 bp, Artificial Sequence
  chemically treated genomic DNA (Homo sapiens)
tttgtaagaaagagaatttttaggggtttgaggttatttattatagataaataaaattttttattggatatttattgtttttaagtattgtattgagtgtttattaaaataattttttttttgaattaaatgaaggattttttgaggtaggtaggtgtttttgttatgtatattttaaagaggagcgtgagatttagagaaagttgagtaaattatatttttaattattttattagaaaatggcggaggtagaatttgaatttatgtaatttaagtttagagttttttgtttatgatttttttataatattttgttttttggttttgtttgaataattataataataataataaatatttattaagtttttagtaagtaaagataatagattggattagaaataaagaggtataattataatgataataattataaaagttgatatttattgtaaatttatttcgagttttataataattttgtggggtaattatgtttattagtttattaaatataggtagaaattaagtttagagtggttgagtgattagtttaaagttatatagttaggataggtggtagagttaggatttgaatttaggtttgcgtgattataaagtttattatgttgaattgttaaaatatagttttagtcgggtacggtggtttacgtttgtaatattagtattttgggaggttaagatgggtagattatttgaggttaggagttcgagattagtttggttaatatggtgaaattcgtttttattaaaaatataaaaattagtatttataggaggtgtttggttaatgggcgttagggataattttattttgaatgtttggtattttcgggtgattgtgagtgttttgtagggtagtttttgtagtgttttggggatggttttttggtaggatggggagggtgaggtagttttgataaggatttcggatatgttttgtaggatatagttgtttaggggagatgtagagtttaagtttttatgatggatttattaaggaataaaaagatagtcgggttttattagtgaggaaggagatgggaatttagtggttatttaggttttacgggttatgtgtgaagtggggaaaattattgttttgtatgttagggttttttattgaataattttgttatggtttttataggtttggtattgttattttggttaaataatattatttagaaggttttggttattttttaaagggtagggttatttgggtttgagaggttcgtttaaggaagaatagagtttgttagtttttattttaatttttttttttagtgatagtaatagtagcggttttggtttatgaatatttattttgttgtaggttttgttgggtgttttaggtattttgagttttttttattagttagtgttataggtggtatttggatgtggtcgttattttattaggggagttggtggtttagggaggggtagggttttttaagtttataagtttggtaggtggaatttggatttagggtttttggtttttttattatattatggtgttttaggttttttaaggtaataagtatttttttagagttttgggaaagggttaagttgttagtattaaaaattaattaatttgtaggataaagggagttaattgattttagagaaagtaagtagtgttttcggatattgggtatattatttaaggaaagcgtaagcgaaagtggaaggagtggggaagtagaggagagggagagaggaaggaaggaggagaagaagaaagaaagataaagagagggagggatgatgaggatgggagagagaaggaaggaaggaaaaaagtaaggaagggaaaggaagaaagaaataaagaaaaagagaaaggaagaagaaagaaaagatagaaagaagaaagaaaaaggaagaaagaaaaaggaagaaagaaaaagaaagaaagaaagagagaaagaaagaaaagaaagaaagaagaaaaggaaagagagagaaaggagttgggttttgttggtgaaaaggagtagttgtataaggttattttatttttttttgtttattatttttatatggggagtaatagtttttttttataaagattatgaagtgaaattatgtgtttatagtgtttgatataggtatttaataaatagtaataaaaattataatggttaatttttatttggaacgtataatgagttagatattatattaagagttttttatttgttaatttttgtagtttttttagtaattttggagggaattattgttattatttttgttttaagatgacggtaggaggtatagagagttgaagtggttattgttttaagttagtttttatattttttttaagggttaattttaagttttttgagttttttaaagtttgtagataggagagagggtgtgaggggtgtttgggattttttttttaggaaaggggtttatttttataatgatatttatggtatttttgtttttttgtttgttttttttaaaggatttgacgttgaaggagtagatttttatggttagggcgttgtggatggagaggaggagaagtagtagtggggttagttttcgtgatattttggcgttgttttggttttaagattttgtgagaagatagtagtgtttggagtgttggattttggttattttcgtaggttttattgatttataaagtttgtagataataggaattattggatttttttttgtaatttttagttttttgaggaattgaagattatgggttttaatttttaaggaaatatagatatattgggttagtttttaaggagtttttatgttcgttattttggtgtagaaattggtatgttttatttaggcgttattttttataaagttatttatattttaatcgggagttagttttgatatttagttatcggttttgcggttgtatgttatgtgtttttttttgatagtggatgaattcggaagtggtttattttagagggtatttggggtgacggaattttttgttgggggataatgaggtaggaggtatgggaaattttgttcggttttttttaaattattgggatttggcggtttgttgtttttagatatatttagattgtgattttaattgttttggtggtgtaaagtaaggttaagagtagtttgaattatttaatttttttaggtagttttatcgtataaatattaggagtgtgttgttagagaaagtaattggggatttgatggaatggatgaggaaaatgtttttggattttgcgagtaaatagttcgtgaaatttatggagagattcgtgattgaagttgatattaatttaatattggcgagagttgtgtgattttgggagagaaaggttttgtaagaattgtaggatattaatttaagtaaaatgatttttagagatatgggtaggaaattatgaagatttgtaaagtaaaaaaaaattaaaaaaaaaagtaaaatttaattaaggtatattaatggattttggtaaagataattttgtgaaaagggtagggaataagaataattttaagttagtatcgggatttgtggattaattttttttgtggtgatgggtttgtggttatagttatagggaaaattatatatatatttttaatatatatttaggtagtatattggtttaagtatgttaggaattttataagataattttaaatagtatatggaaggaaatggttttttgagttcgtgttgtaatgaatttttttgttgtttgtaatttaagattttaggtttggttgaatttttggtaaaggtggttttgggtcgggcgtagtggtttatttttgtagttttagtattttgggaggttgaggtgggtggattatttgaggttaggagtttaaggttagtttggttaatatggtgaaattttgtttttattaaaaatataaaaattagttaggcgtggtggtgggcgtttataattttagttatttgggaggttgaggtaggagaatggtttgaatttgggaggtagaggttgtagtgagttaagattgtattattgtattttagtttgggtaatagagtgagattttattttaataaaatataaaaataaaaaaaaaggagttttagggaatggttaattgttttttttggtgaatgggtattttttaattagaaaaaagatttagaattaaagtgtagaaatgtttaagagatttagagttatggtatattttttttgtgtgttttaagatggaatatgcggtattttatggatttaatgagagttgttgggttaattatatagaaaattttgtaatttttttataaaatgtgtatttggtagggtttgatttaggtttatgattttacgttgaaatttttgtttgaatatagttttggaatatttataaatattttaggttattattaatgttttgtttgtttattttattagaatttaaatgatttagtattttttaaaagtagtttttttgttagtttagataattgaagaatttttaaaagaaaatagggtatattaaataaagtataaaatgtttataaattggttataaattttttataagtaattatttaggtttgttgggtttaggattggtagatttaataaataaaaatatagaatagtaggtagatttgaatttggggtagttcgtatttaattgggtaatttttattttatttggaaattttagttggatttataaaaagaatgagaatttttgtaagttgaatttaaaagtatggtatttttttttttttttttttttaataaagtttttatttttaatttttgtaggtatatagtaggtatatatatttatggaggtatggtattttttaagatagtaattattttattaaagttttagaaaagtttttagtttttagtattaaaaacgagttaatgtgtagaataaagaaagttaagtaatttgtttttttttaatttttagttttgataatttgattatgaatttgaaaaaataaagtaaatttttaaatagtggtttttgtatagaaattgtttttgaggatttaaaaaagagttatatgaatagattaagagatggattttattttcgaattagtatatttattgaatgaaattggattttttaaaaaatgtttggattttggaaggaaaattttaacggttaaatttaattgaatttaattaggtttaggtgttgtattagggttttttgtgttttattttattttatatttgttaagttttttttacggttattttattttagagatgagtaaagtgaggtttgtgtttaaggaaatagagttagtatgtggtaaagttgagatttaattttagagtgttgattttagattaatttttttatttattgaattaggtatattaaaattttaatatggaatattttagggtgtagggagggatgtagggaggagatgaaaggaggatttttattttttattttatatatttgtatattgtttgatttttttttttttttgtaaaaatatgtatttttttagtaattatagaaaaagaaaaaagtgttaaaatttttttatttttttaagtaggttaaataatgtttatgtaaatacgttttttgtttttgtgtgtaatttggttaaaggaagtttttttttatttttaagagttattgattttatttttagaaggtttattttaatttttttatgtaatattggaggatttagggaaggtagaaattttgttttattttttagttggttttttttgttgggaattgggaattttgaggtatttgtttaacgtttgttgatagtttcggggtttttattttcgggatgaagttttttgttttatatatttgtaaatattagtttttaagatgtatttggaagaaaagataaatatgtattatttttttttggagatttagaatgtatattagtatattaaatgttttgaaaagttttgtaattataaaaagtcgtttaattgtgttgaaatagggtgtttaaaatttattgtttgtggagtttttttttttatagaattttttggattattttgagtaatatttatttttgggaatattgtttttgattgtgtagtgataattagatttttttaaagttttaagtttttgttttggttagtaagtttttgttgaagagttttatgtatgttatatgagtgggttgaaacgaggattaggagtttagttatatggtttttatatagttatttattatgggttttgatgggataagagttagtggagagtgatatgttgcgtaaaggttattttggaatttgagaaaagtaagatatggagattttaggaggagtaaaagtgttataggttgagttatttaaaagtagtaagaagaaataagaagtttgtgggaaagtttttatttttggtagaagataagtttcgtgatttaaataggtgtttttagtgattgatgttggtttttgtttaaaaatgaatgagtattaataataattttgtaatatatgtaaaatgttttatcgttatgttttataattagtttagagtttgcggggaggaaggtgtattagttaaagttgtgtaattatgataaattttttatttttgtagggttgtttttagatgatgatatattttgggttttagttttatatattattttttatatagggttgtgtttggattttaagagttattttttgaagggtaggtttgttttgattaaaatttttttagggtttttattggttaaagagtaaattttttaatgtagtttttatttgtttatattttttaggttataatattttattttttttttttttttttattggtttgtttttgtattgtttggttttcggttttttttttagggttttggtatagttgtttttttcgtttatagggttttttttttttttagttttagggtttagtttaaatgttatatttttagagaagtttttttggttttttgattttattagggttttttttcgtttttttttttatggtgtttaggttttttatattatggtatgtattgtaatattttattatttttgagtttgtgtgtttttttgtttaaagttgtttttttattaggttgttatataggggtagggggtattttcgtgtgtttgtgttgtttggaataggattgttatgtagtagtagatgtttataaattattgttgaatgcgacgtatgatattttaatggattttagagattaagttttttttttttttttttttttttttttgagatagggtttcgttttgttatttaggttggagtgtagtggtataattttagtttattgtagttttaattttttaggtttaagtaatttaatttttttattttagttttttaagtaggtgggattataggtgtatgttattatgttttggttaattttgtgttttttttggagagataggatttttttatgttgtttcggttggttttgaattttagggtttaggcgatttttttattttggttttttaaggggtgggatataggcgcgtgtttttttagtggttttagtttcggcgttttgtggttattgcgtttttgtcgttcggtttttttgtgcgttttttggttttcgttttttgttgtgtttttggtg

SEQ ID NO: 187 - DNA, 11047 bp, Artificial Sequence
  chemically treated genomic DNA (Homo sapiens)
taagatgttattttagtgatttttaatacgtttagggaaaaaagagatttaaaattggtaattttatgttataatgtgataattaagtttataaggaattgtgattaaaaaaaaagtttttgatatgtatgtatattataaatatattaaagattagtgtaaaataagggatatttgaggttatatgtaaagtaatgtggggcgtaagataaaattgtatgtatgtttagtattgatttaaaattattagggtgataggaagaaaagaggtgaggtttattttttgaaaagaaagtaaagggattattgaatttttaatgttattttttaaatttttaatagttaaagtttaagaagttatattagggatagattttttggttattatttatattgattaaaataagtgtgtagtataaaagggaatgataatttataatttttttgacgtaaagtaataggtttgggagatgggaagtggtttaagaggaaaattattattgtttagttttgattttttagtttatattgttttaggaataaaggttaagttttaagtagagggtgttgagaatttaataaatgtagttgaatgataatggtcgttttttgttaagtaggttgaggtagatgtatattttaaggtaattgttttgatttatttaatttaagttagaaaatggttgtgttttagtttaaagttagataattggtttattggtggttttataaaattttgatttttgtttatttttaaatttatattttgggttaagtttttaagttgtttgtttttgggtaagatagtaaattttattaattaattaaatttttatttaggattatggatttttttgtttgggtatggagaggttagtgattttattttttagataatgagattttattgtttttaaatttttttgtaagtttttataagttggtttgtgcgaagtttttttttttgtaatttgaatataaaggatttaaatttttattattttaaaatgatagttaaagaaaagttattatatttttttaatattttaataattaaaagagtaagtatatttttatagaattagtttagagtaaggatgataaatgttatattgttttttttatattgttatgggagatttttaagaaaatttattaaatagaggttgagaaatttagattttgttacgtagtaattttttttttttttaggaaatttatgagattagtagatgatgtttattgttaatatttttaagtaaggtaggtgaagtttttgtgttatttttaagagataagttgtatatttttaatagggaagaaagtatattatttgaaaattttttgttaaaagtttttatttatttagaaattgtgtttgtttgttttttgtttttttatataaaataatagaaaaaattggtagggttttaaagtaaaattattggaagttatataagttttaaggatagaatttaaaggggttaggatatttttttatttagtttgttatttagattaggtttgtagtgggttagttgtaagttatttattattattattaaggaagttatatttttttagggattaaatgttattttggattgttgaagaattttatatttaggtagtagttaggagaggagttaagtattatttgggattgtatttattattttttgtttttatttatttttttgttattagtgtgttatttgatatggaataagagaaaagtttttttgggaaatttgttttttgagatattattgtttttattttattttgtttaggaaatatagtatggtaggtatttttaatttttgtaagttttagaataggtttatggtatatgatatacgatttttttatagagttgggatgtagttttatatttttttttaatttagtgttttaagtagtcgttattattggattggagttgttataagataggaagttttttgatatttttagttgtttagaatagaatattatgattaatataaatgtagtgtagtttatttgtttataaatttttaaaatgtattaagaattggttttgaaaaaaaaaggaattggttttattttattaagtaatatatatatcgtttatttttttttagaatagttatttttttagattttttttttaagaaaaagttatttaatagtagaaatgaaaaagaaaattaaatattgatttttaaagattttaaaatgtttatagatttgagtttattttagaattagaatttttaatattgaagaagggaatagggaagatttattgttttttataaatattttgttttttattagtatttttaaatattatattttttaatttaatagtttttttatagttatgtttttttataatttattttttgtattattattatttttaaatatatttttatttgtttataaattttttttattgttttgaaattgttttatagtgtgtagttttttatttgttaaatgtgtatttatttaataattatttttttatatataaagagttgtataaggtattatgaggaatatagatatataaaaaaggaattaattattatagagtttttaatttagagaagatattattattttaaataattataatataaagtagtaagaattgtttttgtttaaggttaagaattattgtggatattgatgttgttaagtttggaatgtggtcggagaaattgttgtagaagttttatataggattttagtgtatatttttggtttaaagtggttcgtagaaagtgatgggaggggtttgtaaggaagaagaggtttttaaatttttttttgaagagaaagtagaatattggtaagtaaaggattttgaatgttaatttatagattaagtattttagagttattttaagttttagagaagtatagtaatatcgttaagaaagttttatgatataagaggaagagattaaaaatttttataggagttgggttttgatatggtaaacgtttaaattagaggttatttttggggaggaaaattttaaaaatatttggtttttaggaattttttttttatacgtatattttattaaagtgtaatagattaaaaggtgttttagttagggtaaattaggtaagtggtttttaaaatttacgttgatttaaaagtttttgtatttttttaaatttttttttaaagaggatagttattttagcgtttatgcgataatttttattgatatagtgggttaaagagtttgttttcgggtatgtaaaaaggtttttttttatataagtgatttaaaaaatgtgtaaaggaaaagataatgttttattagatatagtaaaatattaagttatttttttgtattttgtgttttttacgattatttttttcggtatttttttttttaatttgatttaaagttaaattaattatagtatgtgtaaaaggaaagtaatggatgatttttgtttagaattttgagtttttttaaagtaaattagttagagagaaaaaaagataatgtaattattaatttaattaaaaagtgtttatgtttttgatttttattattacgaattttagtttattaataagttaatagttgttacgtattttgtttttttttggatttttattaaggttgttggttatgatattgagtcgttatttttagaatttaagtgtttttttagttatgagaagggaaaaggaagtaaaaatgtttaggtagttttagtatataatattttgattgttttgtataattatttaataggtttttttttttaacgtttatcgatgaatgtgagtttgttcggtttttgggacgtaatataaaatttttttggggtaaagaggaagaacgtttaggttcggaggttgtttcgattcgtttttatttcgtgtttttttggagcgtttcgtttcgttagcggaagtaaagtttatttttaagatacgtttttttttttttttagggttatttcggagtaaggtcgatttaggacggtttttttttttttgtacgacgtaaaagtatttttttagtgggtttggtttagaagaaaatagaagggatttggttatagtttcgttaagtcgtaattatagagtgtatagggtattggcgtgttgagttttaggcgtggggaaaggaaggcggttttttaaggaacgtttattttttatttttttggggggtgcgtgggagaaggaaagagtttattgaagttttttattttttgttttttattttagggcgggttagcgaggacgtagtttgttttggggttttatgggagggtgcggggaggttcgtttaaagttttaacgtatttaagttattttttatttggaaaggagtcggttgtttggaggttttcgtttcgcggggaagggtttcggattcgattttggtaggtggggagtagcggattagtttaaacgcggagttaatttcgttaaagtttttaattgtacgtatttaagatggtcgttttcgttcggtagcggggcggaaacgagtttttttagtttgttagtcgagtttatattttttggcgaaggtcgtcgaattttcggtagtaaatttcgtggtttttcgtcgtcgttcgcgtatgcgtaacgaaattgttttacgagtcgggaaaagtggcgtttgcgtattagtcgtaggggtgtgttttagtggttatttggaaaggggtgggtagttggtaaaggggttagttagcgtttgcgtagtattaagtttaaggtagcgttttgagttgaagggtttggcgcgtttggaaagcgtttgcgtattttttttattgggggtggtgttaaagcgggaaggtgggcgtggttttagggaacgtttgcgcgttgttttttcgaaggggtggggcgatttttgaattggagttagtgggcgtggttttagaggcgtttgcgcggaggcggttggagggaggttcgatttttttttgttcgggttcgttattttgttaggtagcggtagtggcggcggtagcggcggttggagtttttgattgggtttcggagttcggtattggagttaattagcgcgggtagcgaatcgggggagcgaggtacggtgagtgtgaggagttaatatttagcggtttagagtcggttttagcgtttcgattggcgggtttcgttgattatttaggagaggtttaggcgttcgtcgagttcggggagtcgagttgagtttagtcgagtcgggcggttagcggtttcggttcggggtttgcgagcgtttcggggtattttcggtcgaggtttgtaggggtcgtttcgcgcggggatggcgtttcggggagtaggtatttcggggtttcgattttcgtagggtgttagggttagttgggaatgcgtttttgtttttcgatttaggtttaggtttttaggttttaggtttggggttacgaatggttttatattaggggatatatgcgcgttttgggtttcggcgatttttttttggtcgttttggtcgtaaatttaaatttgtttttgtattttttatttttcggtttttgggataggaagttttttcggggttcgcgtttttcgtttttcgtttttagcgagtcgggtttgttttatttgtagtttttttaggtcgggagggaggtttggggagggtgcgcgtcgcggtcgcggggtttcgtgtgcggttggtaacggggttggttcgtttacgtttcggagttttatgggttcgttttcgttgtttttttggtggggagagggggtcgttagttcgtttattttttttgtttcgtcgcgtttttttttttagttcgtttcgttcgggttttcggttcggcgtcgttattattttttttggttcgttattttttttttttttcgtttcgttcgtagtggtaggatcgtatattttcgttttggagtttaattaagcggttttcgttttttgttcgggttgtaagattagtttattcggtgtttggaattttatttttagaagattgatatttttgcgtatttttttcggaggttgtataatttgttgtttatattattaattttatttattgtttattttgtgaaattttttttttttgggaatatagtatagttttgggggttttttttttttttgtttttgttttcgtttttttatgttattttgtgttaggtttgatttagtttatttattttttggtttatgtttttttgatatatttttaagttttgtgttaacgtttttttagtagatgtttagaaattaatagtgttgtggggttttttttagggtgagaggttgttgttggtaattaattatttagtagttagtatatgttaggtataattcgtgtgttagggagggagtacgtagaggttaataagaattgtgtttatttgatggaaattgataggtgaataggtagttaatatttaacggttagtgttataaaggggttaagtttagttgttgtgaagtatttatgcgtgagttagttttcgtgaaaggtttattattatcgtatttttgattggttttgaagaatgatggtaatttttttataggaaagatggaagagtttgttcgaagagaagaaaagtatgtgtagaggaattaaattatattgttggaggtaggaagatgggatagggaagtgggtagtagttgtgatagtttaggggggaaagtttagttggtaaaatatttgtatattttgttaaggaatattttggaaatagttattattttgtatggaggtttaagtagaagggatttagagttatatttttttttaagattgaaaaaacgagtttttgatttgtttatgggttttgtttcgtgatagtggttgagttttttggggatgaagaggagatttgttttaggattttgaaaattatttttatttatgtgaattatttagtgtattttttggtatataaaggttttaagtatttggtgtttatttttaaatttatatttaatgttatataattaataggttttagaaaattcgtattttagtgtttttttattattaaaatttcggggataggttttatttttattttttagggtgagttttttattgttgtttaagtgatttttttaatttatttgattgttacgttattcgtattagtagatgagatgatagagtttaagtagtttaaaaaatatgtatatttgtttttggaacgtttttttgtttgtttttggatatagggtttttttttgttatttaggttggagtatagtggcgtaatcgtagtttattaatttggaatttttgggtttaagttattttttttttttgtttttttaaaacgttgggattataggtatgagttattgcgttttgatttgaaatagatgttttaattttagtatttaaaaataggtatgttttggttattttaaaattattaaatatttttgtttggtatttttttaaaaggtattataatttggtaatttttttgttaaatattttataagtttttattagtttgtagaagaatttttttgtttgatattttgagagaaagtagtgtggttttaagtttttttttttgtttagtttattgtttatatgttgaaatatttttgtttttgtttttatgtttttttgatttgtagtattttatttttttttatattattatatagttaaattttttttatatttaagattagtttattttgtaggtttttgatagtaaagaaaaaaaaagtttaagtagtatttttttttttttaagttttgttgatttatttttagttggaataaatttttgttttttaaatttttatattattttattttttaggattttagtataggtttttagtttattattaaatttaaagattttttgaagtttgaattttcgttagagatttttttttatttttaaaatttttagaatagtgtttggtatatggtatataattagtggagagaagtgtattagaaagttttaatttagaaatttgtaggatgatggggaagttggatagttttttgttgtagtttagttttttattaagcgtttattaggatttatttgttgagttgtgaaagaaattgagtgagttaatgttgggaatttttaaataatagaatagaaaatatttgttaggtatgatgatggtttacgattgtaattttagtattttgggaagtcgaagtgggagaattttttgagtttaggagtttgagattagtttgggtagtatagggagatttttttttttaaaagaaaaaaaagaatagaaaatattaaagtgtattttgtgttgtataaaggtaaatgttgttttatgaaatttttattttagttatatgttttatatatgtgtgtattgagttgtgataatgaaatgtgttttttattaagggttgtggttaaaaaagttaaaaagttattgttttaggttttgtttggtagtgattattaattgtgataattttatggttttttatatgtttatattagttgagtttttgaagaggttttagttttggagtttgtgtaggtttatatagaatgggtttttagtaagtggttggttaagttttagtttttgtattttggaatagtggggtaaagagaattgtattgagaagagaatgtattaggaagagaatttttatgttagttagaataaatatttattatttgtttttttttttttgaggaaaaattatttaaaattttgtgttaagagtaagagttagatagattaaatttggtttagtttgttataattttgggtaaagaggtattttgggaaagattatcgaattgtattgtagttttgttaattgaagtttatagtagtaggaatatatgattttattgaagttagttgtttatagtattaattattaatagtattaatattatgatataggttaaattattttgttattaatgtgagagagaattgttgttagatttgaagttgttttttaaattttgatattttttaaagtataaatttaaatattgttaaattggtttatttgtattattagaataaattagttaagaagaaaatttgtacgttatatatattagttattatgtgttttaagttatatttagttttgtaaagatgtaaatttttggatattagttaaggaaaaaattttatataagaaggaaatttggagttggggaggcgttgaaatttaaaagatattttttttatgatttttattttttaaaattaatttattgagagatattttagaaataaagtataataattttaaatgtgtattttgatgagttttgataaatttgtatatttgtgtaattgttattataatgaagatataaaatatttttattattttataatgtttttaaggttttatgttagttaattttttttttttttgtttttttgtattttttatttttaaggaattattgatttattttttgtttttagattattgatgttttttggagattttatataaatggaattatatatattcgtttatattataattttaattttattagtttatagttataaatgtattgtgtattagagataagatagaatttagggaagtttgttagtgtttttaatagatttatagtttggttgaaaatttgattttttattttatatttagaatttttgaggagtagatttagttaattaattttaaagagattggtgtaaaaattagaaaatcggtttgttatgttgttgattatatttgttttttgttggttaatttatatgtaaatttaaattatagttagaaatttatttagcgagtattttattagattaagggtagtgttttggagaattatatggttataagtttttttgttgtgatgatatagtttgttatttatggtttatagatttttatgttgtatttattttggttatgagtaatggggttgattaatttttattttgattaaattttgttatattttttttaatattttaatatttatttgggaaataagaattttttaaaatttttattttagaaataagaatttttaagtgtgtagtgaaattaaaggaatttgaaaataaatatttgtatatttgttagttagggtttattaatattttattataattgttttattagatatttttttatttatttatttattttttgatgtattttaaagtaaattttagatattaatatatttttttttaagtatttggatatatagttgtatatattttggtttttttttttatattgtattgagatattttgtaaatgattaattttattagtatgtgtggatttatggagagtggtattgtattttgttacgataatgagtagtttagttaggttacgttattttattatttagatgttggaatttatgagggtttagtgaaaaattagagagaaagatttatttatatttttgtttatatatttgtttttttttttatatttttaagatgaattgtcgattgttaatttatattattttaattttttaatgaagtttttattaaaggtttttagatattatttagtttatttaattgtatttttatttttaaaagtggatttttaatttttaaagtttatgagaagggtaaattttgtttattatatgtagtggatttgagtaatatgtttggtgggaagtaattacgtgttataatttaaagaagttttattttttaaagtatatgtgtaaatttgaaaattagtgttaggtatgttttgtattaaagtgatgtagtttaacgagtattttttaggtgtaagtattgttttgatagtattgaaaggtaaggttgttagtatattgaaagtattttagaaacgtgaaaatagtattatgttgttatgattgtgttatgtaattttagttaaaaatgatattgaatataagtattttttatttttttattttgtttttttgtaaataaagtatagtgataaattatttaggttaattgtttggtaaggtttttattgataattttattttagtttttttttttatttttttaatagg

SEQ ID NO: 188 - DNA, 11047 bp, Artificial Sequence
  chemically treated genomic DNA (Homo sapiens)
tttgttagaaaggtggggaaagaaattaaagtgagattgttaataaaggttttattagataattaatttggataatttattattgtattttatttgtaagaaaataggataggagaataggaaatgtttatatttagtattatttttaattgggattatatggtataattataataatataatgttatttttacgtttttaaaatgtttttagtatattggtaattttattttttaatattgttagagtaatatttgtatttaagagatattcgttaagttatattattttgatataaggtatatttaatattgatttttaggtttgtatatatattttagagaataaagtttttttaagttgtaatacgtaattgttttttattaaatatgttatttaggtttattatatatggtaggtaaaatttattttttttatagattttaagagttgaagatttatttttaaaaataaggatataattagataaattgaatgatatttgagaatttttaataaagattttattaaaaaattaaaatgatataagttagtaatcggtaatttattttggaaatatgggagggaggatagatatataaataaaaatgtagataggtttttttttttgattttttattaggtttttataaattttaatatttgaataataaaatgacgtgatttaattgagttgtttattatcgtggtaaagtatagtattattttttataaatttatatatgttggtggaattaattatttgtaaggtgttttaatatagtgtgaaagaagaaattaaaatatgtgtaattatatgtttaagtatttagaaagaagtgtattgatatttaaaatttattttgaaatgtattaaaaaatggatgaatgggtggagaaatatttggtaaggtaattatagtaagatgttaatagattttaattggtaggtatataggtgtttatttttaaatttttttgattttattgtatatttgaaaatttttatttttagaataagaattttgagaaatttttattttttaaatgaatgttggaatgttaggaaaaatataataaaatttaattaaaataaaaattaattaattttattatttataattaaaatggatataatataagaatttatgagttataaataataggttatgttattatagtaagaggatttgtggttatatggttttttaaagtattgtttttgatttaatggaatgttcgttaggtaaatttttagttataatttggatttatatatagattggttaatagggagtaaatataattagtaatatgataaatcggttttttgatttttatattagtttttttggaattggttgattaagtttgttttttagagattttgggtatagaatagaaaattaggtttttagttagattgtgagtttgttaggggtattaataggtttttttaaattttattttgtttttaatatataatatatttatggttataaattaataaaattaaggttatgatgtaaacgaatatatatgattttatttatataaaatttttaaaagatattagtaatttagagatagaaaatggattagtggttttttgggagtggagaatatagggagataggaaagagggaggttgattggtatggagttttaggaatattgtagggtgatgaaaatgttttatatttttattgtggtagtagttgtataggtgtataaatttgttaaaatttattaaaatatatatttaaaattattatattttgtttttaaagtattttttaataaattgattttaaaaaataaggattatgaaaggaatgttttttaggttttaacgtttttttaattttaaattttttttttatatgagattttttttttgattaatatttagaagtttatatttttataagattaaatataatttgaagtatataatgattaatatatgtaacgtatagattttttttttaattagtttattttggtaatataaatgaattaatttagtaatatttaaatttatattttgaagagtattaagatttgaagagtagttttaaatttagtagtaatttttttttatattaatgatagagtgatttagtttgtattatgatattgatattgttaatggttaatgttataagtaattggttttagtaaagttatatgtttttattattgtgagttttagttagtaagattgtaatataattcgatagttttttttaaagtgtttttttgtttaagattatgataaattaagttagatttagtttgtttagtttttgtttttaatataaagttttgaatggtttttttttaaagagagagaaataaataataagtgtttattttggttagtatgaaaattttttttttagtgtattttttttttagtgtaattttttttgttttattattttaaggtgtaaaagttgagatttagttaattatttattaggaatttattttatgtggatttatataaattttaaagttaaaatttttttagaaatttaattagtgtaagtatatgaaaagttataggattattatagttgataattattattaggtaaagtttagaatagtagttttttaatttttttgattataatttttagtaagaaatatattttattattataatttagtgtatatatgtataaagtatgtaattgaaatgaaagttttatgaaatagtatttatttttatataatataagatgtattttggtattttttattttttttttttttttaagagagggggtttttttatgttatttaggttggttttaaatttttgagtttaaaggatttttttatttcggttttttaaagtgttgggattatagtcgtgagttattattatgtttggtagatattttttattttattatttaaaaatttttagtattggtttatttaattttttttataatttaataagtgggttttgatagacgtttgatgaaagattagattataataaagggttgtttagtttttttattattttatagatttttggattggagttttttaatgtatttttttttattaattatgtattatgtgttagatattgttttgaaggttttaaaaataaaaagaaatttttgacgaagatttaaattttaaagagtttttaagtttagtaatggattaaaaatttatattggaattttaagagataaagtgatatgggaatttggaggatagagatttgttttagttggggataaattaataaggtttaaaaaaaaaaaggtattatttgaattttttttttttttgttattagaggtttgtaggatgaattggttttaagtgtgagaaagatttagttatgtgatgatgtggaggaaggtgaagtattataaattaagagagtataaaaataagaatagaaatattttagtatgtgaatagtggattaaataggaaaaaaagtttggggttatattatttttttttaaaatgttagataaagaaatttttttgtagattggtggaagtttgtaaggtatttagtaaaaaagttattagattataatgttttttagaaagatgttaagtaaaagtatttagtgattttgaagtgattagaatatatttatttttaaatattaaggttaaaatatttattttaggttaggacgtagtggtttatgtttgtaattttaacgttttgggagaataagaagggaggatggtttgagtttaggagttttaggttagtgagttacgattgcgttattgtattttagtttggatgatagaggaaagttttgtatttaaaaataaataaaaaaacgttttaaaggtaaatatatatgttttttagattatttaagttttattattttatttgttaatgcggataacgtgataattaaatgaattaagaaaattatttaagtaataatgaaaaatttattttaaaaagtgaaaataaaatttgttttcgaagttttagtaatgaaagagtattggaatacgagttttttgaaatttattagttgtataatattaaatgtgaatttagaaatgggtattagatatttaagatttttatgtgttagggaatgtattagatgatttatatgagtaaaaataatttttagagttttaggataagttttttttttatttttaaagaatttagttattattacggggtagaatttataaataagttagaaattcgtttttttaattttaggaaaaaatatagttttagattttttttatttgaatttttatataaaataataattgtttttaaaatattttttagtaagatatataagtattttattaattgggtttttttttttaaattattataattattgtttatttttttattttatttttttgtttttaatagtgtaatttgatttttttgtatatgtttttttttttttcgagtaagtttttttattttttttgtggaagaattattattattttttaaggttagttaaaagtgcggtggtgataagttttttacggaggttagtttacgtatggatattttatagtaattgaatttggtttttttatagtattaatcgttaggtattaattatttgtttatttgttaatttttattaggtaggtatagtttttattgatttttacgtattttttttttaatatacggattatatttggtatatattaattgttggataattggttgttaatagtaattttttattttaaggaaaattttataatattgttagtttttaaatatttgttgagaaaacgttaatataggatttgaaagtgtattagaaaaatataaattaagagatgagtggattgggttaagtttgatataaagtaatatagaaaggcgaaggtaaaaataaagggaaaaaaaatttttaaaattgtattatatttttaagggagggagattttataaaatgagtagtggataagattagtaatatgaatagtaagttgtgtagttttcggaaagaatgcgtaagggtattaattttttaagagtgaggttttaggtatcgaatggattggttttatagttcggataagaaacggagatcgtttggttgggttttaagacggaggtgtgcggttttgttattgcgaacggggcggggaagagaggaaatgacgagttaaaaggggtggtaacggcgtcgggtcggagattcgggcggagcgggttgggaggaggggcgcggcggagtagggggagtgggcgaattaacggttttttttttttattagggagatagcgggggcgggtttatagggtttcgaggcgtgggcgggttagtttcgttgttagtcgtatacgggatttcgcggtcgcggcgcgtattttttttaggtttttttttcgatttagaggggttgtagataagatagattcggttcgttgggagcggggagcggggggcgcgggtttcggggaggttttttgttttaagggtcggagagtggagagtgtaagggtaggtttaagtttgcggttagaacgattaggaggaaatcgtcgaggtttagggcgcgtatgtgttttttagtgtagggttattcgtggttttaggtttggggtttgagaatttgggtttgagtcggggaatagggacgtatttttaattggttttggtattttgcgagggtcggagtttcgaggtgtttgtttttcgaggcgttattttcgcgcggggcggtttttgtaggtttcggtcgggagtgtttcgaggcgttcgtaggtttcgggtcggggtcgttggtcgttcggttcggttaggtttagttcgatttttcgggttcgacgggcgtttgggttttttttgagtggttagcgagattcgttaatcggggcgttggggtcggttttgggtcgttggatattggttttttatatttatcgtgtttcgttttttcggttcgttgttcgcgttgattggttttagtatcggatttcgaaatttaattagaggttttagtcgtcgttgtcgtcgttattgtcgttgtttagtaaaatggcgaattcgaataaaggggaatcgggtttttttttaatcgttttcgcgtaggcgtttttgaggttacgtttattaattttagtttagggatcgttttattttttcggaggagtaacgcgtaggcgttttttgaagttacgtttattttttcgttttgatattatttttagtgaaaggaatacgtaggcgttttttagacgcgttagattttttaatttaaaacgttgttttgagtttagtattacgtaggcgttaattagtttttttgttagttgtttatttttttttaagtggttattaggatatatttttgcggttaatgcgtaagcgttatttttttcgattcgtggggtagtttcgttacgtatgcgcgggcggcggcgggaaattacggaatttattgtcggaagttcggcggttttcgttaaagagtgtgggttcggttagtaagttagaggggttcgttttcgtttcgttatcgggcgggggcggttattttagatgcgtgtaattaagggttttggcgggattggtttcgcgtttgggttggttcgttgttttttatttattagggtcggattcggagttttttttcgcggggcggggatttttaaataatcgatttttttttaggtgaagggtgatttgggtacgttggggttttgagcgagttttttcgtatttttttataggattttaggatagattgcgttttcgttgattcgttttagggtaggagatagagaatgggaggttttaatagatttttttttttttttacgtattttttaaaaaagtggggggtgaacgttttttgagaggtcgtttttttttttttacgtttggggtttagtacgttagtattttgtatattttgtggttgcggtttaacgggattgtggttaagttttttttgtttttttttaagttagatttattggggaaatatttttgcgtcgtgtagagaaaaggagatcgttttaaatcggttttgtttcggagtggttttggagaaaggaggaggcgtgttttagggatgggttttgttttcgttgacggagcggggcgttttaggaaagtacgaaatgagagcgggtcgagatagttttcgaatttaagcgttttttttttttgttttagaagggttttgtattacgttttaggggtcgaataaatttatatttatcgataaacgttggggaaaaaagtttattaagtggttgtatagggtaattagaatattatatattaaggttgtttaagtatttttatttttttttttttttttatagttgaagaaatatttaaattttggaaatagcgatttagtattatggttagtagttttaatgaagatttagaaggaagtagagtgcgtaataattattgatttattggtgaattgaaattcgtaataatggaggttaaaagtataaatattttttaattaaattaatgattgtattatttttttttttttttagttgatttattttaaaaaggtttaaaattttaggtagggattatttattattttttttttatatatgttgtaattggtttggttttaaattagattggaggaaggggtgtcgggagaggtagtcgtgggggatataaaatatagaaaaatagtttagtattttattgtatttaataaaatattgtttttttttttgtatattttttagattatttatgtgaaaggagatttttttgtatgttcgaaaatagattttttagtttattgtattagtgaggattgtcgtatgggcgttgggatagttgttttttttaagaagaaatttggaggggtgtaagaatttttaaattaacgtgagttttggaaattatttatttggtttgttttggttagagtattttttaatttgttatattttaataaaatatgcgtgtaaagaggggatttttaagaattaaatgtttttaagatttttttttttaagaatggtttttagtttagacgtttattatattaaaatttaatttttgtgaaggtttttaattttttttttttgtattatgaaatttttttgacgatattattgtatttttttgaaatttgaaataattttgagatgtttagtttataggttggtatttaagattttttatttattaatattttgttttttttttaaagaggaatttagaaatttttttttttttatagattttttttattattttttacgggttattttaaattagaaatgtgtattagaattttatgtaaagtttttgtaatagttttttcgattatattttaggtttaatagtattagtgtttatagtgatttttagttttagataaaagtaatttttattgttttgtattatagttatttggaatgatgatattttttttggattgaaaattttgtaataattaattttttttttatatatttgtattttttataatgttttatatagttttttgtatgtaaaaagataattattgagtaaatatatatttggtaagtaaaaaattatatattataaaataattttaaggtaatagagaaagtttgtggataaatgaggatatatttaaaagtagtagtggtataaaagatgggttgtgaggaaatatgattgtaagaaagttgttaagttaaggaatatagtatttgggaatgttgataaaaagtaaagtgtttgtgggagataataggttttttttatttttttttttagtgttgaaaattttagttttgaggtaaatttagatttgtaaatattttaaaatttttagagattagtgtttggtttttttttttatttttattattaaataatttttttttagaaaagaaatttggagaagtggttgttttgaagagagatgggcgatatatatattatttggtaagatggggttaattttttttttttttagggttagtttttaatatattttaaggatttgtgaatagatgggttgtattgtatttgtgttgattatgatgttttattttagataattaagaatgttaaaaagttttttattttatgataattttagtttagtgatggcggttatttggagtattgggttagaaagaaatgtgaggttgtattttagttttgtgggaaagtcgtgtattatgtattataggtttgttttaagatttgtaaaagttaggaatgtttgttatattatattttttaggtagagtgagataaaaataataatgttttaagagatagattttttaaaggagttttttttttattttatgttaaatagtatattgatagtaagggggtgaataaaaataaaaaataataagtgtagttttaaataatatttagttttttttttaattattgtttgaatgtggggttttttaatagtttaggatggtatttggtttttgaaagggtgtggtttttttagtggtggtggtgggtagtttatagttaatttattataagtttgatttggatgataaattgagtggggagatgttttagtttttttgaattttgtttttaaagtttatgtggtttttagtggttttattttgggattttattagttttttttgttgttttatgtagagagataaaaagtaagtaagtatagtttttaaataagtagaggtttttagtagggaatttttaggtggtatgtttttttttttgttagagatatgtagtttattttttggaagtggtatagagattttatttattttgtttaaaaatattgataataggtattatttgttaattttatgggttttttaggaaaaggaaagattgttacgtggtagagtttgggttttttagtttttatttagtggatttttttgaaggttttttataatagtgtggaaagggtaatatgatatttgttatttttgttttagattaattttataaaaatgtgtttatttttttaattattgggatgttgggggaatgtgatgatttttttttggttattattttgggatgatgaaagtttgaattttttgtgtttagattataaagaaaagggtttcgtataagttaatttatgaaaatttatagaagagtttagaggtaatgaagttttattgtttgaagaatggagttattgatttttttatgtttaggtaaggaaatttatggttttaaatggagatttaattgattggtggggtttattattttatttaaagataaataatttaaaagtttaatttaaaatatagatttaaaggtggataaaagttaaaattttgtaaaattattagtgaattagttgtttggttttagattaaggtatagttattttttagtttgagttgaatgaattaggataattattttgaaatatatatttgttttagtttgtttagtagagagcgattattgttatttagttatatttgttgaatttttagtattttttgtttgaagtttggtttttatttttaaagtaatgtaagttaaagaattaagattgagtaatggtggttttttttttggattattttttattttttaaatttattattttgcgttaagaaagttgtaaattattatttttttttatattgtatatttgttttggttagtatgggtaatagttagaggatttgtttttgatgtaattttttagattttagttattgggaatttagggaatgatattgagggtttagtagtttttttgttttttttttaggaaatgggttttattttttttttttttgttattttggtagttttgagttaatgttgagtatatatgtagttttattttgcgttttatattattttgtatatggttttaaatgttttttattttatattggtttttgatatatttatggtgtatatatatattagaaattttttttttaattataattttttatggatttaattattatattatgatatgaaattattaattttaggttttttttttttttaggcgtgttgaggattattagagtaatattttg

SEQ ID NO: 189 - DNA, 6204 bp, Artificial Sequence
  chemically treated genomic DNA (Homo sapiens)
ggttttattacgttggttaggttggttttaaatttttgattttaagtgattcgtttgttttagttttttaaagtgttaggattataggatgagttattacgttaggttttaagatttatttattaatatttaattaatttagttttaggtgagttttaggttagatgatagatgttgagattatgaagatagggtttaaggggtttaagtttttaggaatttatagtttaggggaagatgtttgttagtacgtggttagagagttagttagatttgatttttattttgagtttttatttagtttttagttgtgagattagttttgagttagttttttatttttttagttttcgtttttttaattgtaaaataagaattataatattatttttattgggttttggtgaggattaaatgagataatttatgtaaaatgtttagtatagtttttggaatatagtagtaattatttaattaatgttaattattgtttttttttaggaagtaggttaatatgtggatttattagaatttaaggtagagaatgtattttagatggggaaataatttgtcgaaggagtttggtaggagattaattttgttagtaagaatagaaggaagtttagaggaggtgatgttgtaatagggttttgaagaatgagtaagagtttttaggtagggattgaggaaagagattttaggtagaaggaagattatttatagaggtatgaagttgtagaaggtgtagatatgtttggaggaaggtaatatatttagtagggtttgtgggattaggttagaaaaggggggatttaggttagtttttgtggaatttattttttttttgagatagagttttattgtattatttaggttggattgtaatggtgtaattttagtttattgtaatttttgttttttgggtttaagcgatttttttgttttattttattgagtatttgggattataggtgttcgttaatacgtttggttaatttttgtatttttagtagagatagatttttattatgttggttaggttggttttgaatttttgattttaggtgatttattcgtttcggttttttaaagtgttgagattataggcgtgagttattgtgttgggtttgtaggattttatgatttaaataaagagggagaaagaaggaatattaattgagtttttattatatgtatggtattgaattatggtgttttttttttttttttttttttttttgagatagagttttattttgttgtttgggttggagtgtagtggtatgatttcggtttattgtaatttttgtttttcgggtttaaacgatttttttgttttagttttttaagtagttgggattataggtattcgttattatgtttagttaatttttttgtatttttagtagagacggggttttattatgttggttaggttggtttcgaatttttgattttaggattcgttcgtttcggttttttaaaatgttgggattataggtatgagttattgcgtttagttatggtattgaattaaatggttagttttttgtttattgtttgtttttgagataaggttggttttgttttgttgtttagattatagtatagtagaatagttatagtttattgtaatttcgaatttttttttaagtttaagtgatttttttgttttagtttttagaatagttgggattataggtatgttattattacgttcggttaattttttgtaaagttggtgttttgttatgttgtttaggttgatttcgaatttttggttttaaatgatttttttgtttcggttttttaaagttttaggattataggtatgagttattgtgtttggttagtatttttaaaatttaatttggattggtcggatacggtggtttttagtattttgggaggttgaggtgggcggattatttgaggttaggagtttaagattagtttagttaatatagtaaaatttcgtttttattaaaaatgtaaaaattagttgggtatggtggtgggtatttgtagttttagttatttgggaagttgaggtaggagaattgtttgaatttgggaggcggaggttgtagtgatttaggattatattatcgtattttagtttaggcgataagaggaaattttgttttaaaaaaaaaaaaaaaaaaaaattaatttggattttattttgtcggtagtagggaattatagagatttttaagtcgattgtgatatgattgaatttttttttttttttttttttgagttagggttttgttttatcgtttaggttggagtgtagtggagggatttgggtttattgtaatttttattttttgggtttaagtaatttttttgttttagttttttgagtagttgggattataggtacgtgttattatggttagttaatttttatttttgttttgagatggagtttcgtttttgttgtttaggttagaatgtaatggcgcgatttcggtttattgtaatttttatttttcgggtttaagagattttttttttttagtttttcgagtagtagggattataggtgtaagttattatgattggttgatttttgtatttttagtagagatagggttttattatattagttaggttggtttcgaatttttgattttaggtgatttgttcgttttagttttttaaagtgttgggattataggcgtgagttatagtgtttagtttaatttttgtatttttagtagagacggggttttattgtgttggttaggttggttttgaattgattttgtgatttattcgttttggtttgaatgtttatttatttaatttttaggatgatgtttttggtagttagtggaagaataggatagagtaaggagagaataattaggtggttaaggtagtggtttaagggatagaaattgtagtatttagttaagaggaatttggcggggttgtggagaaaggttagtgtttgggttgaagagaatttttgtaggttaaatttatagtcgtagaggtagattttatgtgttattggtggggaggttaatgagggaaatagaggttagtttttgagaagttagaagtagggtagggtttgaatgaatggaataaagttatgggacgtaaagtttttaaatttgattttgaatttggtatatttttgagtttttttgtgattttgaaaatgttatattatgttgtttttagttttttattagcggataatatggttttttttatttgttatttatgattgtgagaaagaaattaggtagggagtgtataaggtgtgtaagtgttttgtaagtagtaaattattaaataaattttagattttatgttattagggaggtagttggtcgtacgggatagcgtagttataagagattataggcggagatgggggatatttgttttgtggtgtagataaatagtttaattaatatatatatattttataggtaaatatagtaatttttatattgagttgtgtttattagagggtaataggaggtttttaatttttattattagtgattttatgaattgttttgtagatgtttttgttttttattggatatgaggtggtacgagcggtttgaatttgtagatttagataggttttaggtatttggggaattatgtgagtaaaattttgtattgtttttggggttagaatttagttttttttaaatatttagaaggatttgtgattgtttttaaaggttaagagttattgattttttttattagaaattaataagaatagttatttttggggagaaggaatgatgggggtagggaaagatttttatttaatatttttgatttttttgaacggtttgtattttttaaataggaatatgtattaggtttattgaaaaaaaatatgttagggttagttgagtagtgagataatgggttttttttagatttttgtttttatatttgttcgtattaaataaatataaatattaataatatatttttaaagatttaaaaaaataaaaattaaaaattttgatagtattagtatatatatagaaattattttattatgtaaagtttattttttattatgaaaggtaaaatgtttatattttttattaattattggttttaatttagtaaaatttgtatattaagtaggtaaggtggaaaagaaaaaggtagaatattttatgtattttaatttagacgtataaaaatgttaagttttatacgttattagttttcgtatatatcgttttttgtattcgtttgtacgggttaatgggttagttggtcggcgtttgatgtttgaagtgatggaacggagtacggggttaaatttattattttttttttacgtattttagtaattattttatttttacgttatgttttcgggtgtgtgtgtttttgtttacgtagaaattgaagtttaaagtaggcggagttatttatgttttttttgttgtttttagaatttaatttaggagttgggtttttagaggatttggagatatttggggattatttaattagttgattttcgcgtggtaagaggtttttaatttcgttattacgtggtgttaagggtcgggaaaagggagagcgggtaggagggagttgtattaggggtatttaaagtgttttgacgttacgtattgttaggaatttagttgagtttttagtaggatatttcggttatttttttttttttttttcgggtttttgtgtttaagttttcggtttttttttcgttgtggcggagggaggagtatcgaattgtcggaatagttagtataggggcgtattagtttttttttggtttcgtttttttttttagttgttttttttattggttagtgggcggggtttcggttgtatcgtatacgtattgggatttttgggtggtcgaacgagttggttttttatgaattatgtatgacggcgtgtttcggttaggttggggttgggcgaggattggttgaaggggttgtaatttagcggttttcggagttgcggcggcgtagattgggagggggagtcgggggtttcgacgtcgtagtcgagggaataagttttaatcggattttggataggtatttcggtttggcgttgtttttttttttcggttcggagaggtttttcggtttgagggagtttcgtcgttcgttttcggtatacgcgtacgttcggtttttcggtttttgtcggagaaataggtgaagggggtgtagggtggggtcgttggggaggtttggggattcgggggtttcgtagcggtagggggtttttgggattttggggatgttgtgatggacgttgtagtggggtcgggagagatgaagagacgcggagggtcgttttgagggaagatttttcgggatgataggagcgggtttcggaagggattcggggcgttggagggaagtttcgtttttcggagaaatagaacgcgttcgagggggtatcgtggggcgagggcgtattcggttgcggcggtaggagtgagggatagtttttcgattttttgttttttggggttttggggacgtttcggttatcggagcgattgttacgtcgacggggattatcggcgcgagtggggggtcggaaagcgtttttttttcgttcggtcggcggttttcgttgagttatttttttcgtttgttttgttttcgtttttttaggagttagttgtgtttttttggaggtaggaataggtgtgtttgtcgtttgtagttttacgggttggttggtcgtgggtaggttttattgtataagaattaagttttttgtagggaaattgatagatcggtattttttttaaattttttcgtatttttttttaggttaaattatgttttttttacgttttcgttttgtaaaaaagagaaaaaaagataaaataaaatttttattaattcgttaagttagttttagagagagaaataaattttttgatattgtttttttttaaatatttggtaaagtcggttagaagataaataattgagttattgtatttattggattgtggtgttgtttaattgtataggacggaatgaattaattgagagtgggagttttttgttttagagttaagattttgggtaaatgtagaggagagggaaataaagataggttggttttgaaaaaattatgtgtgtaaattttatatgtatttggggggtgtggttgtattgaagttaataagattta

SEQ ID NO: 190 - DNA, 6204 bp, Artificial Sequence
  chemically treated genomic DNA (Homo sapiens)
tgaattttgttaattttagtgtaattatattttttaaatgtatgtaaagtttgtatatatggtttttttaaggttagtttgtttttgttttttttttttttgtatttatttaagattttggttttgagatagaaaatttttatttttaattggtttatttcgttttatgtaattaagtaatattataatttagtaaatgtaatggtttaattatttattttttggtcgattttattaggtatttggaaaaggataatgttaagaggtttatttttttttttagagttggtttgacgggttgatggggattttattttgttttttttttttttttttataaggcggggacgtggggggagtataatttaatttagaaaaagatgcgagggaatttagaaagagtatcggtttgttaatttttttataggaaatttgatttttatgtaataaagtttatttacgattagttagttcgtaaggttgtaggcgatagatatatttatttttgtttttaaaagggtatagttggtttttgaaggagcgggaatagggtaagcggaggaagtggtttagcgggagtcgtcgatcgggcggggaggaggcgtttttcgattttttattcgcgtcggtgattttcgtcggcgtgatagtcgtttcggtggtcggaacgtttttagggttttagggagtaggaaatcgggggattgttttttatttttgtcgtcgtaatcgagtgcgttttcgttttacggtgttttttcgagcgcgttttgttttttcgaagaacgaaatttttttttagcgtttcgagtttttttcgaggttcgtttttgttatttcgaagagtttttttttagggcgatttttcgcgtttttttatttttttcggttttattgtagcgtttattataatatttttaaggttttagaggttttttgtcgttgcggagttttcgggtttttaggtttttttaacggttttattttgtattttttttatttgttttttcggtagaggtcgagaggtcgggcgtgcgcgtgtgtcggggacgggcggcgaggtttttttaggtcgaagggttttttcgagtcgagggggagagatagcgttaagtcggggtgtttgtttaggattcggttggggtttgttttttcggttgcgacgtcggaattttcggtttttttttttagtttgcgtcgtcgtagtttcggaaatcgttgaattatagtttttttagttaattttcgtttagttttagtttggtcgaggtacgtcgttatgtataatttatgaaaggttagttcgttcggttatttagaggttttagtgcgtgtgcggtatagtcgaagtttcgtttattgattaatgaggagagtagttaggagaaagggcggagttaagaggagattgatacgtttttgtgttggttgtttcgatagttcggtgttttttttttcgttatagcgagggaagagtcgaggatttgggtatagaagttcggggggagggagggaagatgatcggaatgttttgttgaaaatttagttgagtttttggtagtgcgtgacgttaaggtattttaaatgtttttgatatagtttttttttgttcgtttttttttttttcggtttttggtattacgtggtggcgaggttgagagttttttattacgcgggaattagttagttagatagtttttaggtatttttagattttttggggatttaatttttgaattgggttttggggataataaaaagaatatgggtgatttcgtttgttttgaattttagtttttgcgtgagtagggatatatatattcggaaatatgacgtggaaatagagtaattattagagtgcgtggggagagggtagtggatttaatttcgtatttcgttttattattttaagtattaaacgtcgattagttagtttattggttcgtataggcgaatgtagaagacggtgtatacgaaagttgataacgtgtagggtttgatatttttatgcgtttgaattgaaatatatgaaatgttttgttttttttttttttattttgtttatttggtatgtaagttttattgaattgaagttagtggttgataggaaatgtagatattttgttttttataatagaggatgaattttgtataatggagtgatttttgtgtatgtgttgatattattagggtttttaatttttatttttttgggtttttaaaaatatgttattaatatttgtgtttgtttaatacgaataggtataaagataaaaatttaaaaaggatttattattttattgtttagttaattttgatatatttttttttaatgaatttaatatatgtttttgtttagaaaatgtagatcgtttagaaaggttaaaaatattaaatgaaaatttttttttatttttattattttttttttttaaggatagttgtttttattaatttttagtgagaaaaattaatgatttttaatttttgaaggtagttatagatttttttgagtgtttgaaggagattagattttagttttagaaataatataaggttttatttatatggttttttagatatttgaagtttgtttaagtttatagatttagatcgttcgtattattttatatttaatgagggatagaggtatttatagggtaatttatagggttattggtggtgagaattgagaattttttattgttttttggtagatatagtttagtatggaaattgttgtatttatttgtagagtgtgtgtgtattgattaggttgtttatttatattataggatagatattttttattttcgtttatagttttttgtaattacgttatttcgtgcggttaattgtttttttgataatatagggtttaggatttgtttagtgatttattgtttataaagtatttatatattttatatattttttgtttggttttttttttataattatgaatagtagataggagaggttatattattcgttgatagaaaattaaagataatataatatgatatttttaagattatagagaaatttagaaatatattaggtttagagttaggtttgggggttttacgttttatagttttgttttatttatttaaattttgttttgtttttgattttttaagagttggtttttgttttttttattggtttttttattagtaatatataaaatttatttttgcgattatgggtttgatttgtaaaaattttttttagtttagatattggtttttttttataatttcgttaaattttttttggttaaatgttgtaatttttgttttttgggttattgttttaattatttgattattttttttttattttattttatttttttattggttgttagggatattattttaaaaattaaataaataaatatttaggttaaggcgggtggattataaggttagtttaagattagtttggttaatatagtgaaatttcgtttttattaaaaatataaaaattaggttgggtattgtggtttacgtttgtaattttagtattttaggaggttgaggcgggtagattatttgaggttaggagttcgagattagtttgattaatatgatgaaattttgtttttattaaaaatataaaaattagttagttatggtggtttgtatttgtaatttttgttattcgggaggttgagggaagagaattttttgaattcgggaggtgaaggttgtagtgagtcgagatcgcgttattgtattttagtttggataataagagcgaaattttattttaaaataaaagtaaaaattagttagttatggtggtacgtgtttgtagttttaattatttaggaggttaaggtaggagaattgtttgaatttaggaggtggaggttgtagtgagtttagatttttttattgtattttagtttaggcgatagagtaagattttggtttaaaaaaaaaaaaaaaaaaaaatttaattatgttatagtcggtttaaaaatttttatggttttttattatcggtaagataaaatttaagttaatttttttttttttttttttttgagatagagtttttttttgtcgtttaggttggaatgcgatggtatgattttgggttattgtaattttcgttttttaggtttaagtaatttttttgttttagttttttaagtagttgggattataggtgtttattattatgtttagttaatttttgtatttttagtagagacggggttttattgtgttggttaggttggttttgaatttttgattttaagtgattcgtttattttagttttttaaagtgttgggagttatcgtgttcggttaatttaagttaaattttaaaaatgttgattaggtatagtggtttatgtttgtaattttaaagttttgggagatcgaggtaggaagattatttgaggttaggagttcgagattagtttgggtaatatggtaaaatattaattttataaaaaattagtcgggcgtggtggtggtatgtttgtagttttagttattttgaggattgaggtaggaggattatttgaatttagaaagaagttcgaagttatagtgagttatgattgttttattgtattgtagtttgagtaatagaataagattaattttgttttaaaaataaataataaataaaaagttgattatttaatttagtgttatggttgggcgtagtggtttatgtttgtaattttagtattttgggaggtcgaggcgggcgaattttgaggttaggagttcgagattagtttggttaatatgatgaaatttcgtttttattaaaaatataaaaaaattagttgggtatagtggcgggtgtttgtaattttagttatttgggaggttgaggtaggagaatcgtttgaattcgggaggtagaggttgtagtgagtcgagattatgttattgtattttagtttaggtaataaagtgagattttgttttaaaaaaaaaaaaaaaaaagaaaaaaatattataatttagtgttatgtatgtggtaggagtttaattgatgttttttttttttttttttttatttgaattataaaattttataggtttagtatagtggtttacgtttgtaattttagtattttgagaggtcgaagcgggtggattatttgaggttaggagtttaagattagtttgattaatatggtgaaagtttgtttttattaaaaatataaaaattagttaagcgtgttggcgggtatttgtaattttaggtatttagtagggtgaggtagaagaatcgtttgaatttaggagataaaggttgtagtgagttaagattgtattattgtaatttagtttgggtaatatagtgagattttgttttaaaaaaaagataaattttataaaggttgatttgaatttttttttttttaatttagttttataaattttattaaatgtgttatttttttttaaatatgtttatattttttgtaattttatgtttttgtggatagttttttttttatttggaatttttttttttagtttttatttgagaatttttatttattttttaaagttttgttgtaatattattttttttaggtttttttttatttttattggtaaagttaattttttattagattttttcggtaggttgtttttttatttagaatatattttttattttgaattttaataaatttatatattggtttattttttgaaaaaaaataataattaatattgattaagtaattattattatattttaggaattgtgttaagtattttatatagattattttatttgatttttattagaatttagtgagggtaatattataatttttattttataattgaggaaacgaagattgagaaagtgaaagattggtttaagattggttttatagttagaaattaggtggaaatttagaatgaaaattaggtttggttgattttttggttacgtgttaataaatatttttttttaaattgtgggtttttggaaatttgaattttttaagttttgtttttataattttagtatttattatttagtttagagtttatttaagattgaattaattaaatattaataaataagttttgaggtttgacgtggtggtttattttgtagttttagtattttgggaggttgaggtaggcggattatttgaggttaggagtttgaaattagtttggttaacgtggtgaaatt

SEQ ID NO: 191 - DNA, 7588 bp, Artificial Sequence
  chemically treated genomic DNA (Homo sapiens)
tttttttgttttattttagtttaggttttattgttttttttatatgtttttaaatgtaattttttttttggggtttggatttgtagagttaggttttgtttattagggtagcgttggaggaaggtttgtagagtttttttttttattttaaaagatggagttattatttatggttatttttgttatttgcggttgggtttatattttttaattttggtgttgagtataaggggttttttttaattatgggttgatgatttttagggtgtttggtgttaagttatttttataagaaattagatgggtttttggataaaggtaatttgtttttatttattggtgttttgtattggcgaagtaaattttaatttgtttttataggaaaatatgataatttgtataataatattatgatagttttatatattaatataaagttttttgttgattaggtattgtcggattaaatgagttaagatgagtttttttagagtatgtggtttttattattttgtgtttaggtatttgataatatagatagtaggtgtttaataaatgtttgtttattgaatatatgaatgaagaaatatttagtttttgagtgaaattaatatttagtttattagggtttaggttttttaagtattagaaagggtagagttatgaatttgatttaatgatttaaaaattaattattgttattttttttttatagaaattagttgtttttttggtttttgttgataggtatttttttattttttgttttgtgagaggttggtttttagttattattttagtttttgttgtttgacgggatattttatatttttttatatttatttttttttttttatatttatatttattaatggaattaatttttgagaaattttgattttgagttttgattttggtgatttttgttgttgtggtttttggtttgtaattataaatattgaattttgttttggaatagtttaaatataatatttgttttagtggttttttggtaaagagtttttttgataaatttaggaattttggtgttatttttagttgttgttttattttgatgttgtttttttacgttttatgttgaaatgtaatttttaatgttggaggtggggtttaatgggaggtgtttgggttatggagatagattttttatgaagggtttggtgttattttggtggtaatgaatgaatttttgttatattatttttcgtgagagttggttgttaaaaaaagaaagaaagaaagaaaaagtcgggtatttttttttttttttattaagagtttgcgtacgttagtttttttttgtttttcgttatgagtggaagtagtttatagtttttattagaagtagatgtcggtgttatgttttttgtatagtttgcgaattatgagttaaataaattttttttttgtataaattatttagttttaggtttttttttatagaaatatagatggattaagatagttgttattttgagatttttgttattagttatataagggttgtatttagtaagtattgttcggtattttgttgttattttttggagattgttgatttttttttgttttttagattgttgggtttgttttttttgattagttttaataagtttttgatatttttaatatattattagttattatagtgtgaatggaatgaggattattttattgttgtgatgtgagttttatagaaaaatgtatagaaaagtaattaaaataatgtagtaaaggattagaaaatggaggaaatgtttattttttattgatatgtaaagaagttggagttagttggattaaattgatttaagattatttatgagtatatgtatttagtacgtgaagattatttatgagttttatatatatttggtaagtgagaattttttaaagtttaaaattggtgttattaggtatagggaattatttattggtattaatgttatagttattttggaaaatatattaaaatattatttatttttttttttatttttagtaagtaaatggtaatatttttttttaaggaaattgaaaaaatttaagggattattttatttagtttgatattaaagttattttagtttataagtattagatatatggagtagttgtgataaaagtaaagatatttataaattatatttttaaaaaagaattttgagagtgtttatatatttaagtttttataaaagttagtatgaaagtagtaatagaggaaaagagaaaatagttgagttgatattatataatagttaaatggaagggggataaattggtatagttaaatagattatttgattataaaaattaagagttttaaaaatgtgtaaattattagaattaataattttatttttaaaaatttattttgaaaaaaagaattaaaagttaaagatttttaaataaaaaagtgtgtttttttgtttttttgttttttgttttttttttgtttttttttgttttttgttttgagatagagttttattttgttgtttaagttggagtgtagtggtataatttttttttattgtaatttttgttttttaggtttaagtgatttttttgttttagttttttaagtagttgagattataggcgtttagtattacgtttagttaattttttgtatttttagtagagatggggttttattatgttggttaggatgttttttatttgttgattttatgatttatttgttttggttttttaaagtgttgggattataggtgtaagttatcgtgtttggtttgtaaatatgtttttaagtttatttaatgatataggaaaatatttaagttaaagtaataggtgaaaaaattttaatagttgtatatgtagtataattaaaattatattaaaatattattttatatagaaaaaaagaaaagatataaatgtattaaaatattaatattgtttatttttgtatgatgagattgtgaatgattttttttttgagatagagttttattttgttggttgggttggagtgtagtggtattattatagtttattgtaattatagtttattttaggttttatgttattattttgtttttatagttgggattataggtgtgtgttattttattatattttatttaattttttttttttttgagtcggagttttatttcgttgttaggttggagtgtagtggcgtaattttggtttattgtaatttttattttttgggtttaagtgatttttttgtttcggtttttcgagtaggtgggattataggcgcgcgttattacgtttagttaatttttgtatttttagaagagatagggttttattgtgttggttaggttgggtttaatttttaggtttcgtgatttgtttattttagttttttaaagtgttggaattataggtgtgaattatcgtgtttagttttttaatatttttaaagattatataaagaaaagtatagtttttatatatagtttaggagttagggttttgagtgaaatggagtataaggtgatggaagattgtttttggttttgaggattattttgttggatgattagagtttgttttttatttggaagaattatggttttttttttggagagaatttggagttttggttatattttttgagtttttgatattaagattcggtgtggtgtgtgagtagttgggagtaaatgtgagaatagttttgttaattattttttttgttttattattatttattttattttttttatttcgatttttattttagaaaattaatattaagtttttttttggaggggttttttttttttttttttttttaattagtttttttttttttgaagtaatattaaatattagaataaatttatttatatataatgatggtttttaaatatttgaagattatgttggtttttatgagagggtttttttgttttagattaaattaaattaggtttttgtgtgatattttttaagtttttttttattttgttaattttttttggatgttatatttggaattgttaagggttatttaataggtagtgtttggagttaatattggttttttgttttggttagaaagatatattgtaattttgttgagtttgtaaagaatgtttaaggggtatttgtgttcgtagttgttcgtgtagtattttagtttgcggtgttagattcgaatttagagttgtgttaaatgagttaggatttttttttgttgtttttgtgtattggtaggggtattaggttattagtgttaggagattttggttagtgtttatttgtgttgttatatgtagggttttggtagtgaggtttggagaaggaagagaaggggtagggaatttatacgttttgttggttattttttatcgtggttttgttacgggaattttttttttttatttttattttttattttaggtagaaatattttttatttttttttttttttttaagaatttttttttaaaattttggtattttttatatatatttgtatttttgttatatttgtgggttttgttttttttgtaggattttttttggaaagttaattttttttgatattggagaattttattaaattgttgagtattttttttttttttttatagattttatggtatgtttagattatagtagaagatattttttttgttgttaaatttatggtattttgaggttgattgtgtttattttatttttttagttgttttttttttgttgttattattatgttttaagtagattttggagtattttttttatagtagtatggattttggtagattttttggggattagcgatgttttaatttgtttgtttttttagggttgatgtttgtagggtgttttttttttttttttgaattaaagtagaaattattttgtatttttatgtaattttttcggtaggttttaatagataaataaagtttattattttttatgggtttattttttttagtagagtatttgggttggtttcgaagtttttaattatttgtacgtttgttagggtttttttggggtagttatgaagtttttcgttttgtttttttgttttgtttagttttggggttgttatttagttttatatggtttagggttgatttatagataatcgaattgcgatgatttagaaattgaggaagtagttttggtggttatagattatattaattaaaattttttttggggatataaatatattttgaattagattgatgaagtaaaggtgtggttttaggtaagtggatttgttgtttatgagttgaaataatgtgtatatggagtttaattaggtgttttaaaaaattattattatttagtgtaaatgaaattatagaggagtaaattttttgatttttttttaggagtgagggaaggggtaggtagagggtaggagaggagatattttgtatggtagttatgggtgttaggagggagttgggtggggtgtgaggtggtgtgtaggagaaaaagtgttttaaatggtagtgtgtagattatagatagaaagtgtaatttgttggaaaaattaggatttaagagattagtttttagttgttaagttattattggttgaaaattacgtatttgtttttggtttggtttttttttaataaagattgagaatgaataaaattagtatttggtagatgtttattatatgttaggtttatttatatagattattttatttattttttttcggttttgttttttggtgttgtgtggtatatatattgtttttgttttatttaagaggagattaaggttttgttgtgtgtgtgtgtgtagtttttttgttttttgtttttgtttttttttttttggtttaaaattatataattattaagtttttaggttgggatttgattttatatttgtgtttttttttttatataaattgttttttaaagagagttatttatattttagagagaagttttggtataaatataatttatttttttatatattagataggaaattaacgtagtttgaagttagtgataagaaaaattaagttggaaatatgtttcggggattagttaagagatttggagaggtggaaagaagttgtttgtttattgtttgttttgaaattagatttatttttgattaaggataatttttttagtaaatatgtattataagttttttttggataagaattagagatattaggttgaattatataaaattgttatttttttatattaaaagtaattaaatattggtcgttttaatggtttaatttaatatagtggtgaaaaaggtataatatgtgtttataagagtttataatttaggttggaaaataaggttaataataggaagtttggatcgattgacgattgttattcgttttataaagagataaaatatttgaaattaggattgtttcggatggattttaagagtgttgtagttatattaaagtatagtggtggttaggaggaaacgttgattaagttaggggaaatgaatacgtaatacgtatatttgagggaaaaggtaattatgaatgggtattgtgatttttattaaaggtagagttttagagttggtttttttgagaaatttaggtgtattcggtttttgttcgttagagttgtgaacgtttttaggtagttattttgggtatatttggatattataaaatgcggagttttttttaggggaggggatgttgaggttttaggtattagtgaattaggtagaattaatgagaggtaaatagagttgggttgagaggagaaaaggtatatttgtattttttggattttttaggtttcgaagataagatatagaaataggtgaatttataagaatatttttaaggattgttgtaagttttttcgtgtttatattagtgatatttagttttttgttagagggagatatgtttttttttattatcgttagtagggggaagtagagagtagtatcgttgtatgtcggtatttgttgtataagttaagataaaggaaaaattaaggataatagtagtaaaaatttttaggagggaaaagaaaacggaggaaggaaggaaagtaaataatgaaaaggaagaaagaaagaaggagagggagggatagaggagattaaaaaaagatagtaagatattattttatattattttattttgtagtttgtttgagaaaaatttaaatttgtattttttaaagtattgtttgaagagtgaaattttaaaaaattaaataaataataaatataaataagtgttaatatttatttgtagtttttaaatagagtttagagtgagggttgtggttttatcgatttgtttaagtttaggatttcgtttgttttgcgagtattatttggtgtttttttaattaatagacgaagattagataagttttggttattgttttgtttataggttagtttagagttagacggagttgtagattgatagtaagaatgatattttttttatttttttaaaagcggggtgtttttaagtttaatgagggcgtatatcgtggatcgtattataggattaggggaataggttgtttacggttttattttttgtttttatagt

SEQ ID NO: 192 - DNA, 7588 bp, Artificial Sequence
  chemically treated genomic DNA (Homo sapiens)
gttgtggagataaagagtgaagtcgtgagtaatttatttttttgattttgtggtgcggtttacggtatgcgtttttattgggtttgagagtatttcgtttttggagaggtgagggaaatgttatttttattgttagtttgtaatttcgtttagttttgaattggtttgtgggtaggataatgattagggtttgtttggttttcgtttgttgattaaggaagtattagatgatgttcgtaaagtagacggggttttgggtttgaataagtcgatggagttatagtttttattttgagttttatttgaaaattataaatgggtgttaatatttatttgtatttattatttatttaattttttaagattttattttttaagtagtgttttggaaaatgtaagtttggattttttttagataagttgtaaaataaggtggtgtagggtaatattttattgtttttttttaattttttttatttttttttttttttttttttttttttttttttattatttgttttttttttttttttcgttttttttttttttttagaggtttttgttgttgttgtttttggttttttttttgttttggtttgtgtagtaggtgtcggtatgtaacgatgttgttttttatttttttttgttggcgataatggggaagggtatgtttttttttgataggaaattggatgttattagtgtagatacgagggagtttgtaataatttttggagatatttttgtgagtttatttgtttttgtattttgttttcgaagtttgaaaaatttagaaggtataagtatgttttttttttttttagtttagttttgtttgttttttattggttttgtttgatttattagtatttgaagttttagtatttttttttttgggagaagtttcgtattttatgatgtttaggtgtgtttagagtgattgtttgaaagcgtttatagttttggcgaataggaatcgggtatatttgggttttttaagggaattaattttgaagttttgtttttagtaaaagttataatgtttatttatgattatttttttttttagatgtgcgtgttgcgtgtttattttttttgatttgattagcgtttttttttaattattattgtgttttaatatggttgtagtatttttaaaatttattcggagtaattttgattttaaatattttgtttttttgtgagacggatggtagtcgttagtcggtttaggttttttgttgttgattttattttttaatttagattgtaagtttttgtgggtatatattgtgttttttttattattgtattaggttgaattattaaaacggttaatatttggttgtttttgatatagaaaaatggtagttttatatggtttaatttaatatttttggtttttgtttaaggaaggtttgtaatatatatttgttgaaagaattgtttttaattagaaataaatttaattttaaaataggtagtaggtagatagtttttttttatttttttaaattttttgattgattttcgaggtatatttttagtttgattttttttgttattggttttaagttgcgttggttttttgtttagtgtgtgaggaggtgaattgtgtttatgttaagatttttttttgggatgtgggtaattttttttgggaggtagtttgtgtagaagaaggaatatagatatggaattaaattttagtttgaagatttagtaattatatgattttggattaaaaaaaaaaagataaaaataaaaaataaaaaaattgtatatatatatataatagagttttggtttttttttgggtaagataagaataatatatgtattatatagtattaggaggtaggatcgggaaagagtaaatgagataatttatgtgaatgggtttggtatatagtaggtatttgttagatgttagttttatttatttttagtttttgttagagagaaattaaattaaagatagatacgtgatttttagttagtggtaatttggtaattaggagttggttttttgggttttagtttttttagtaagttatattttttgtttgtgatttgtatattattatttgaagtatttttttttttgtatattattttatattttatttagtttttttttgatatttatgattgttatatagaatgtttttttttttgttttttgtttgtttttttttttatttttgggaagaaattagagaatttatttttttgtggttttatttgtattgggtgatggtgattttttgaggtatttgattgagttttatgtatatattattttagtttatagatagtaggtttatttatttgaggttatatttttattttattaatttggtttaaggtgtgtttgtatttttaaggaaggttttgattgatgtagtttatagttattagagttgtttttttagtttttggattatcgtagttcggttgtttataaattagttttgggttatgtggggttgagtggtagttttagagttgagtaagataaaggagtaggacgagggattttatggttgttttagagaggttttggtaggcgtgtaggtggttggaggtttcgggattaatttaggtgttttgttgggaaaggtagatttatggagggtggtgggttttatttatttgttggagtttgtcggaagaattgtataaggatataggatgatttttgttttggtttaaaagaaaaaaaaaaatattttgtaaatattagttttggaaaagtaaataggttaggatatcgttggtttttaagaaatttgttaaagtttatgttgttgtgggggagatgttttaaagtttgtttggaatatggtaatagtagtaaagagaagatagttgagggaatgaggtggatatagttagttttagagtgttatgggtttggtagtagaggaaatgttttttattgtgatttgagtatgttatggggtttgtgagagggaagggaggatatttagtaatttgataaaattttttaatgttagggggagttagttttttaagaggagttttatagggagaataaggtttatagatatagtaaaggtatagatgtgtataggagatgttaagattttgggggaagatttttggagaaaagaaaaaggatgagagatgtttttgtttaaagtggggaatggaggtggaagaagggggttttcgtggtaggattacggtgggaaatgattagtaaaacgtgtgggttttttgtttttttttttttttttttagattttattgttagggttttgtatgtgatagtatagatgggtattgattagagttttttagtattagtaatttagtgtttttgttagtgtataagggtagtagaggggagttttgatttatttgatatagttttgggttcgagtttgatatcgtaggttgagatgttgtacgagtagttacggatataaatattttttgaatattttttgtagatttagtagaattatagtgtgtttttttagttagaatagagggttagtgttgattttaggtattgtttattaagtgatttttgataattttaagtgtgatatttaaggagggttggtaggataaagagaggtttgggaaatattatataaggatttggtttggtttagtttgaagtaaagaagtttttttatggagattaatatggtttttaaatatttagaggttattattgtgtgtgggtgaatttgttttaatgtttgatattgttttagagaaaaaaaaattggttaaaaaaaaaagaaagaagagggtttttttaaagggaagtttaatattgattttttggggtgagaatcggggtgagggaggtgaagtgagtggtgatggggtagagaaggtagttggtaggattgtttttatatttatttttagttgtttatatattatatcgaattttaatgttagaagtttagaaggtgtggttaggattttaggttttttttaagagggggattatgatttttttagatgaaaaataaattttggttatttagtaagatgatttttaaagttaggggtaattttttattattttatattttattttatttagggttttgatttttgaattgtgtgtggaagttatgtttttttttatataatttttaaaaatattgaagggttgggtacggtggtttatatttgtaattttagtattttgggaggttgaggtgggtagattacgaggtttagagattgagtttaatttgattaatatagtgaaattttgttttttttaaaaatataaaaattagttgggcgtggtggcgcgcgtttgtagttttatttattcgggaggtcgagataggagaattatttgaatttaggaggtggaggttgtagtgagttaagattgcgttattgtattttagtttggtaacggagtgggatttcgatttaaaaaaaagaaaaattgaataaagtgtggtaaggtggtatatatttgtaattttaattatgaaggtaggatgatagtataagatttggagtaggttatggttgtagtgagttatgatagtgttattgtattttagtttagttaatagaatgagattttgttttaaaaaagaaattatttataattttattatgtagagataaatagtgttaatgttttgatgtatttatattttttttttttttttatgtaaaataatattttaatataattttgattatattgtatatatagttgttaaaatttttttatttattgttttaatttgaatatttttttatgttattaagtagatttaaaaatatgtttataggttaggtacggtggtttatatttgtaattttagtattttgggaggttaaggtaggtggattatgaggttaatagatagagagtattttggttaatatggtgaaattttatttttattaaaaatataaaaaattggttgggcgtggtgttggacgtttgtaattttagttatttgggaggttgaggtaggagaattatttgaatttgggaggtagaggttgtagtgaggggagattgtgttattgtattttagtttgggtaatagagtgagattttgttttaaaataaaaaataaaaaaaaataaaaaaaaaataaaaaataaaaaaataaaaaaatatatttttttatttaggaatttttggtttttgatttttttttttaggatagatttttagaagtaaaattattgattttaatgatttgtatatttttaaagtttttaatttttatagttaaatagtttatttggttatgttaatttattttttttttatttagttgttgtgtgatgttagtttagttgttttttttttttttttgttattgtttttatgttgatttttgtgggaatttagatatgtgaatatttttagaatttttttttaaaaatgtaatttatgaatatttttgtttttattatagttattttatatgtttaatatttataaattaaaataattttggtattaagttgagtaaaatgattttttagatttttttagtttttttagaaagaaatgttgttatttatttattggaaatgaggaagaaaatagatgatattttggtatgttttttaagatggttgtagtattagtgttaatgggtagttttttgtgtttgatgatattagttttaaattttaaaagatttttatttgttaaatgtatatgggatttatgagtgatttttacgtgttgaatatatatatttatgagtaattttgggttagtttgatttaattggttttagtttttttgtatattagtaggagataggtattttttttattttttggttttttgttgtattattttagttatttttttgtgtatttttttatgaggtttatattatagtaataaaataatttttattttatttatattatgatggttgatagtgtattgaggatattaagggtttgttagaattggttaaggagagtaggtttaatagtttaaggagtaggagaggattaataatttttaggagatggtagtagggtgtcgggtagtgtttgttgggtgtaatttttgtgtggttgatggtagaaattttaagatggtagttgttttagtttatttgtgtttttataaagaaaaatttgaggttgggtaatttatatagaaaagaggtttatttggtttatggttcgtaggttgtataagaagtatgatatcggtatttgtttttggtgagggttataggttgtttttatttatggcggaaggtaaagaagagttggcgtgcgtaagtttttggtgagagagaggagagatgttcggttttttttttttttttttttttttttaataattagtttttacggaaaataatatagtaggaatttatttattattattaggatggtattaagttttttatgagggatttgtttttatgatttaaatattttttattaggttttatttttaatattggggattatattttaatatgagacgtggggggataatattaaagtagagtagtagttaaggatggtattagggtttttgaatttgttaaaaggattttttgttagggagttattagggtaagtgttgtatttaaattattttaaggtagaatttagtgtttatagttgtaggttaggagttataataataaagattattagggttagagtttagggttagagttttttagaggttggttttattagtggatgtgggtataggagggagaggatagatatagaaagatatgaaatatttcgttaggtagtaagagttaaggtgatagttagaaattagttttttataaaatagaagatgaaaaagtgtttgttagtaaaagttagaaggataattggtttttgtagggaggaaatagtagtggttggtttttaaattattaggttaggtttatggttttgttttttttggtatttaaagggtttaggttttgatagattgggtattaattttatttaaagattgggtgtttttttatttatatgtttaatgaataaatatttattgagtatttattatttgtgttattagatgtttggatatagagtgatgagaattatatgttttggaggagtttattttgatttatttagttcggtaatgtttgattagtaaagaattttatgttaatatatgaaattattataatattattatataaattattatatttttttgtggagataggttgggatttatttcgttaatgtaaagtattagtgaatgaaagtaaattatttttgtttaaggatttatttggttttttgtgaaagtaatttagtattaagtattttggaagttattaatttataattaggaagagttttttgtatttagtattaaagttgggagatgtgggtttaatcgtaggtggtaaaaatgattataagtaatggttttattttttggggtggaaaaaggggttttgtaagtttttttttaacgttgttttgataagtaggatttagttttgtaaatttaaattttagaaaggaaattgtatttgagaatatataaagggaatagtaaggtttggattagagtagggtaagggag

SEQ ID NO: 193 - DNA, 5774 bp, Artificial Sequence
  chemically treated genomic DNA (Homo sapiens)
ggtaggaggattatttgagtttggaaagttaaggttgtagtatattatgatggtgttattgaattaatttgggtaatatagttaatagagtgagattaaaaaattaaaaaaatagattagatttttgttgtttaagttggttgttaatttttagttttaagtaattttttttttttagttttcgaaattgttgagattatgggtgtgagtcgttgtgtttggttaaggttttttgtttttttttttaagttatttatttgtttaattttttttttttatgagatggagtttaatttattttgttgttcgggttagagtgtagtggtataattttagtttattgtaatttttgttttttgggtttaagaaattttttgttttagttttcggagtagttgggattagagacgtgagttattaattttgtatttttagtattttagtatttttgtattttgatttttgtatttttagtagagatggcgttttattatattgtttaggttagttttgaatttttaagtttaatttatttatttgtttttagttttttaaagtgttgggattataggcgtgagttattatatttagttggttttttgttttagtaataattttttgttgttttttttttagattttcgaggtttgtcgataggttcgaagttattttgagttttttgaggatttagtgtaagtgtttaggaatttggttggtgagttggtggtgtgtatatatagttagaggttagaattaagattttttatagtgattttgagtttttatttaggattggtatttttttgtggatttttagttttataaggatagagaaatagtttgtaatgggagtgataaaaatgaaagaataaatttttagggattgtaatattttgttttgtaaaaatatattagaaatttagaagtaggagaatgaagtaaatggaatttatataaagaaaatgaggttggaagacggtgtattagttttatttttatttttttaaaaaaaataaaaggttggaggaggaggtggaggcggtcgacgaggacgatgaggaggacgacgacgagggagtattcgggcgcgggtcgggttacgatcggggtcgcgatcgttatagttttttcggttgttattttttttcgtcgtcgtcgtcgtcgtcgttatcgttgttttcgtcgtcgtcgttttcgtcgttaggtaagcggtcgtttcgattttttttttaagttcgagtgggagtcgcgggcgcgcgaagtcgggcgggggcgaggtatttatcgcgcggtcgagtcgaggcgaattcggagcgcgaattcggggttcgggttcgtggtttcgcggcggttcgggaggtcggggcgggcggtggcggttgcgatcgcggggttaggtttttttttttttttcgtcgtatttttttttcgtcgtcgtcgtcgtcgtcgtcgttatttcggttggagagcgttgggcgcgagttgcgcgcgcggatcgggttattcggtcgcggttttcgggggaggaggaggaggaggttttttttttattttcggcggggagggggtaggtaggaaacggttaaggcgaagttagggttttttttttggtcgagcgagggatcgtcgagattttggcggtcggacggcggcgtgggggaggggtacgtgggggaggggcggtcgcgcgagcgtttttcgggttttggtttcggtggggttggatcgagggagagtggggttttttcgtacggagtagtcgacgggtttgtttttttcgtttaggatttggataggtagagtgaggacggtgtttatcggatttttttttattcgcggagatttaggtgttcgttaattgaggggtatgcggtggtacgcgagggaggggttttgtgaatgtttgtgggttgttgatgagtaggggtaggtggtggttatagtttacgtagattattttttggaataaggtaggagttcgttttttcgtttttttagtttgtgtagggatagtagtttattcggattggggagcggagagaagagtgtttggggaattagatgtttttagttttattttttttatttcgtcggggttttgggtttttttgtgttaagtgcggtgggggggggttttttttttgatttcgttagtttggggtggttaagttgtttagttgtgatttttacgtggttgttatttattgttatttattttttcgttgaaattatttattttttgagtacgttggggggcgtgaattgtttatttagttgttttgtagtttgattattatttagtattcgtttttcgaggtgataagttattcggcggtattttttgggcggcgttttttagatcgttgcgtcgcgttaggcgtttagcggtgttttttttagattatttttttagtggagtgatttttagttttttttgggataggtgagtatttgggtgtttatattttttgtttggggaatagtagggggattttcgtattttcgggtttttggttgttatgcggtataaatgtattaaattttaaaacggttaatttcgggttttttgtaaaattgttatattgattcgtgtggtttttgtggtaaacgtttttgtttagtcgagacgatttttgggggagcggggggtgtttttttgtgggtcggggagggatgtgtgttttttggaaattggataaagttttttcgttttttaagtttgtttgaaaaagggtaaagttttgaaaaagtttttttagagagttttttgttttggtaggaggaggaggaatgaggagttgtggggagagggtgtttttggggttgttttcggtagaggcgttgaaaagagggaaagaaaggtcgttaggttttgttaggggtttggtagcgtttatttatttgtattgggatttggagtttggggtggggtggtgtgggtttcggatttgggtacgttggggagagaagcgtgaaaggattcgaggttgagatgggtttttgtgttaattcggtttttttttttttttttggttttttgaatagattagaagagacgttagaggttgtttatattttataattgaaatgaaaatttattttttttttttttttgggtaatttttattttttttttagttttttaagtcgaatgagtgatttagatatatttttttagatgattttcggaggtaaaatttcgggaaattatttttagtatatttattatttttgtttatttaagtgtggggaaaagaatttttttttaaggaaatttgtttaggttgttttcgtttttttttgtttagagtatgtatttgtgtataggagagatttttattgttttttatttcgattgttttgatttttattattttgttttatatttttatttaagattaattttattttttttttttttttttagtttttttatattgttaaacgtttaaaataatagtagtcgtgttggtgggggaagggagtaggaagttaaaaatttatttttttttttttttttttttggtaagtcgagagaaataatataatataatatatagatgtgattttttgggggtgggggtggggaatgattgtgggtggtgcggaaaattttggtagtttttttgtaaaaggtttgaaaatataaatttattttttgtttgtagtacgtatgtgtagtagatttattatggtggtgcgttgtgggggagggaggggaatttgagaaaaaataaatatatgtgtgagagattgatggtgagattagaagaagagaggggcgggcgggaggcgaggtttcggtcgagatttttttcgtttgttcgggcggttaggtttcgttttgcgtttttcggttttcgttttttttttttttgtttttttgagattcgagtcggggatgtgggagagtttgggttttaggttagtattgagtggttgttgagatcgaggttgggatttagatttgttttattatttttttttgtttttttttgtcgttttcgttttgtttttttcgttatcgacgtttgtttaagttcgggaatttttcgttggggtggggagtagagtgaatcggtttgtgtattatttttggttggtggtggtcgaggtcgtgtttttgaattttagttagttggtttgtttttgttattgtttcggtagtttgcgtttttatgtttaagttaatcgaagtttttggggttagggggagtcggttgttggggtatggcgttttttttgttgattttttattatagtttttatttcgttttatattcgggttttggtagttatttttttgtatatacgtatatagttttagagtgtttttttgtataaggggatataggatgttggagttagtaggaaaggtggtattgaaggaaggcgaggtagcgattttgaggtagtggaaacggaggtttttggtgttaattgtggttaatttttcgttggttgttgagggaaggagaaaggattgtgtgttttagagttaggggttgggttaagtttaggtttttttattttgtatcggttgtttttttttgtattagataggtttggttggttagtttagtgtttggtaggggagggacgtgaattagagttttagggttttaggtttgtggggtattttgtttttttttatgtggggtaatttttcgtttcgttttttaagtttttatagagtgatatttttatagataatggggtggggggtttggggttttttggtagagatatttggggagaaagttagggatttatttttgttgaagtaggtataggttattttttggatttgtgggtttgagagtgtgtgtgggtgtgggtgcgcgcgtgcgcgcgcgtgtttttgagaaggtatatgttgggtgtgtttgtttgtgtttatatttttgtttgggttttttatattgcgtatagatgaatgggttaggatatttggaataaaatatggaggtgaagggtgagatcgggaaataaagggtatggttttttagtttttaaagggagtagggagatgggaatagaattgaaggtaggttttaggttatttgggaggaggaatatttaggtaattgtggagatttttttttgtgtgatgaaggtggtagatattgtgattttgtgggtaagaagtaaaaatgattagttgaggatttttttttttttaggattgtgttggggtgataggatgtttggtaattattcgaggaaatgtaaatagaggttttttttttggtaaaaggatgttagggttttagggtgttagtgtgagaatttaggtgtttatttttggttttttttttttagtatttggtttagggagttgttagtttgtgtttttttattttaagtgttggggttaggttaggttagtagttgggtatggtttttttagtttttgggtaggatgttagttggcgaagtgagggggaaggtaggaggagttttggcggtgattgaaaggatttgttatagttagagtttatggtttggagtttggttttttgttagtaggaggggagggaggggagtggtttggttgttttttttttttgatttttgattttttatttagaattagagtattttagagtattcgaaatattttttgtttgtatttagtgaagggaggtagggtttggaggagttaatgttttttagagagtgggaattgtcgaggtggggaaggggtaagttgaggggttttagaggttggaaatttagaggtttaggttttttgatgttttttgttttaaaga

SEQ ID NO: 194 - DNA, 5774 bp, Artificial Sequence
  chemically treated genomic DNA (Homo sapiens)
tttttgaagtaaaaagtattagaaaatttaagtttttaggtttttagtttttgaggttttttaatttgttttttttttatttcggtagtttttattttttaggaagtattaatttttttaagttttgtttttttttattggatgtaaatagaaagtatttcgagtattttgggatgttttggttttgaatgggaggttaggggttagaagagaagagtagttaaattatttttttttttttttttttattaataagagattaggttttaggttatgggttttgattgtggtaggtttttttagttatcgttagggttttttttgtttttttttttatttcgttagttggtattttgtttaggaattggggaagttatgtttagttgttggtttggtttgattttagtatttggagtggggagatataagttggtagttttttaagttagatgttggggagggagagttaaaggtggatatttgggtttttatattaatattttggggttttgatatttttttgttaagagggaggtttttatttatattttttcggataattattaggtattttgttattttaatatagttttggaggaaaagaaatttttagttggttatttttattttttgtttataggattatagtgtttgttatttttattatataggagaaagtttttataattatttaaatatttttttttttaagtagtttaaaatttatttttaattttatttttatttttttgttttttttgggaattagggggttatattttttgtttttcgattttattttttatttttatattttgttttagatattttgatttatttatttatacgtagtatgggagatttaaataaagatataggtatagatagatatatttagtatatgtttttttaaaagtacgcgcgcgtacgcgcgtatttatatttatatatatttttaggtttataaatttagaggatggtttgtatttgttttagtagggataggtttttggttttttttttagatgtttttgttagaggattttaggttttttattttattatttgtgaaggtgttattttgtgaaggtttggggaacggaacggagagttattttatataaaggaagataggatgttttatagatttggggttttggggttttggtttacgttttttttttattaagtattagattaattagttagatttgtttagtatagagagaggtagtcgatgtaagatgggaaagtttgggtttggtttagtttttagttttaggatatataatttttttttttttttttaatagttaacggaaaattagttataattaatattagaggttttcgtttttattgttttagagtcgttgtttcgtttttttttagtgttattttttttgttaattttagtattttgtgtttttttgtgtaggaagatattttaggattgtgtgcgtgtgtgtaggggggtggttgttagagttcgggtgtgaaacggaatggggattgtaataggaagttagtaaggaaggcgttatgttttagtagtcggttttttttggttttagggatttcggttgatttgaatatggaaacgtaggttgtcgaggtagtggtaagggtaggttaattggttaaggtttagggatacggtttcggttattattagttaggggtggtgtataagtcggtttattttattttttattttagcgggaggttttcgaatttgggtaggcgtcggtggcgggagaggtaaagcgagaacggtaaggaaaagtaaggaagggtaataaagtaaatttaagttttaatttcggttttagtagttatttaatgttggtttggagtttagatttttttatattttcggttcggattttagggaggtagggaggagagaggcgggggtcggagggcgtagggcggagtttggtcgttcgagtaagcgggaggagtttcggtcgaagtttcgtttttcgttcgtttttttttttttttaattttattattaattttttatatatatatttatttttttttaaattttttttttttttttataacgtattattataataggtttgttgtatatgcgtattgtaggtagggggtgggtttgtatttttagattttttgtaaagaaattattagaatttttcgtattatttataattattttttatttttatttttaaggaattatatttatatattatgttatattatttttttcgatttgttagaagggggagggagaagaaatgagtttttggttttttgttttttttttttattaatacgattgttattattttaaacgtttaataatgtaaggagattggagagagggggaagggataaaattggttttgagtaagaatgtaaaataaaatggtgagaattaaagtagtcggaatggaaaataatggaaattttttttgtgtataaatgtatattttagataaggaagagcgagggtagtttgaataaatttttttagaggagggtttttttttttatatttaggtagatagaaataatgagtgtgttaaaaataatttttcgaagttttattttcgaaagttatttgagggggtgtatttgggttatttattcgatttggagggttgaaagggagataaaaattgtttagggggagaggggaggtgggtttttattttagttgtaaaatgtaagtagtttttgacgttttttttggtttatttagaaagttaagagggaaaggggaggtcgggttgatataaagatttattttaatttcggatttttttacgtttttttttttaacgtatttagattcgggatttatattattttattttagattttaagttttaatataaataggtgagcgttgttaagtttttggtaggatttgacggtttttttttttttttttttagcgtttttgtcggaggtaattttaaaggtattttttttttataattttttattttttttttttttgttaaggtagggggttttttgggagaatttttttaaaattttatttttttttagataagtttggggggcggggagattttatttagtttttaggagatatatattttttttcgatttataagaaagtatttttcgtttttttaaaggtcgtttcggttagataggaacgtttgttatagaagttatacggattaatatgatagttttataaagagttcggagttggtcgttttgaagtttggtgtatttgtgtcgtatggtagttagaggttcgggggtgcggaggtttttttgttgttttttaagtagggggtgtggatatttagatgtttatttattttaaagaagattagaaattattttattaggagggtggtttgagggggatatcgttgggcgtttgacgcggcgtagcggtttggagagcgtcgtttagagagtgtcgtcgggtgatttgttatttcgggggacgggtgttgagtgatggttaagttgtagaatagttgggtgggtagtttacgttttttaacgtgtttagggagtgggtggttttagcgagagagtgagtgatagtgaatggtagttacgtgagagttatagttgggtagtttggttattttagattgacggggttaagagggggatttttttttatcgtatttgatataaaagagtttagagtttcggcgagatgaagggggtggagttgggggtatttggttttttagatattttttttttcgttttttaattcgaatggattgttgtttttgtataggttgggggagcgaggggacgagtttttgttttattttaggaagtggtttgcgtggattgtggttattatttgtttttatttattagtagtttataaatatttataagatttttttttcgcgtgttatcgtatgttttttagttggcgggtatttaagttttcgcgggtggaggggggttcgatggatatcgtttttattttgtttgtttaagttttgagcggagggggtaggttcgtcggttgtttcgtgcggggaaattttattttttttcggtttaattttatcggggttagagttcgaggggcgttcgcgcggtcgttttttttttacgtgttttttttttacgtcgtcgttcggtcgttagggtttcggcggtttttcgttcggttagggagggggttttggtttcgttttggtcgttttttgtttatttttttttcgtcgagggtaaaaaaaaaatttttttttttttttttttcgaaagtcgcgatcgagtggttcggttcgcgcgcgtagttcgcgtttagcgttttttagtcggggtggcggcggcggcggcggcggcggcgggggaggggtgcggcgggggaggggaggaggtttggtttcgcggtcgtagtcgttatcgttcgtttcgatttttcggatcgtcgcggggttacgggttcgagtttcggattcgcgtttcggattcgtttcggttcggtcgcgcggtgggtgtttcgttttcgttcggtttcgcgcgttcgcggtttttattcgggtttggggggggagtcggggcggtcgtttatttggcggcgggggcggcggcggcgggggtagcggtggcggcggcggcggcggcggcgggaagaggtggtagtcgggggggttgtggcggtcgcggtttcggtcgtggttcggttcgcgttcgagtattttttcgtcgtcgttttttttatcgttttcgtcggtcgtttttatttttttttttagttttttattttttttaaggaaataagaataaagttgatatatcgttttttagttttattttttttatatggattttatttattttatttttttgtttttaggtttttgatgtgtttttataggataaaatgttataatttttagaaatttatttttttatttttattatttttattatagattgtttttttgtttttgtgaaattgggagtttatagggaggtgttaattttggataaaagtttagaattattgtagagaattttgattttgatttttaattgtatatatatattattaatttattaattaggtttttgggtatttgtattgagtttttagaaaatttaaggtagtttcgggtttgtcggtaagtttcgggagtttaaaggaagaatagtagggagttgttattaaaatagaagattagttggatgtggtggtttacgtttgtaattttagtattttgggaggttggaggtaggtggataaattgagtttaagagtttaagattagtttgggtaatatggtgaaacgttatttttattaaaaatataaaaattaaaatataaaaatattaaaatattaaaaatataaaattggtggtttacgtttttaattttagttatttcggaggttgaggtaggagattttttgaatttaggaggtagaggttgtaataagttgagattgtgttattgtattttagttcgggtaatagagtgagttagattttattttataaaaaaaaaaaattaaataaataaataatttaaaaaaaaaaatagaggattttggttaggtatagcggtttatatttataattttaatagtttcggaggttaagaagggaggattgtttgaggttaggagttaataattagtttgggtaatagagatttggtttatttttttgattttttggttttattttattgattatgttgtttaggttggtttagtggtattattatggtgtattgtagttttgattttttaggtttaagtgatttttttgtt

SEQ ID NO: 195 - DNA, 6620 bp, Artificial Sequence
  chemically treated genomic DNA (Homo sapiens)
tttgtgaggttttttttttaattttttaaaaggttatttgaaatagtaagttagtaagttaaattttaattttagggttagtataagtattgttatacgatgtaatagtttggtgaattgtgataataattttaaaaagttatttatagttaggtgagatggtttatgtttgtagttttagttttttgggaggttgagttggtagggtagtttgagttgagtttagtttgggtaatatagtgaaatttattttttaagaaaaaagaaaattagtgaattattattacgatgtaattgtttattttttaggttgggtgtagtggtttatgttcgtaattttagtattttgggaagttgaggtaggtagattgtttgagcgtacgagtttgagaatagtttgggtaatatggtaaaattttatttttataaaaaatataaaagttagttaggcgtagtggcgtgtatttgtagttttagttattcgggaggttgaggtacgagaattgtttgaatttaggaggcggaggttgtagtgagttaaacgtattattgtattttagtttgggtaatagagtaagatttttgttaaaaaaaaaaaaaggtagtattttttatattaaaagggtatttagagttgaagttttaatgttttagttataaaggaggtagaaagtttgggcgtgtggtttatgtttgtaattttagtattttgggaggtcgaggtaggagcgtaggaggattatttgagtttaggagtttaagattagtttgggtaatttgtttttttaaaaaaaaaacgaataaataaaattagttgggtatggtggtgtatgtttgtaggtttagttatttgggagataggtaggaggattaattgagtttagaagtttgaggttgtagtgagtttgtttgtgttattgtattttagtttgggtattagagtaagattttgttttaaaagaggaaaaaaaaaaaggaggtagaaaaaatgtttattaatttttgtagtttttattaaaataaaaagattattttggtatggttatgatagaaattttaaattattttagggtttagagtggtatttttttgaagttggggaaaggattttgggtagaaagtaaaggagggggtagatttttggttggtttgatgttttgtaattttgggtttgagttatataagagtatttagtgagttaaggtttaaaggaggagggaataattattttttgggaaagggttatataatttggaatattatagattttttagacgcggagttgagattagagtgttttttatcgtttgatgaaataatttagtttattttaaggacgtgtatttggaaaaatgattggtttttggaaatagtgttattttgttatttaggaataattttgttgattgagttttaataaggaaaataggttttaattaattatattttttaagtgttagaggattcgttagataataattttattataataataagagtatttattgagtgtttattttagggtagtattttatatttattatattatttaattaagaagatttttatttggtattaatttaatattattttggttttgttagttgtggttttatttaggattttgtttaaaatttagagaaatttgattataagaaaatttaataagttataaaatattatatttttttttttattgtattgttttggttgtttaaaaaaatggtttagaaatagtattgtattaatgtttatatttttattttggttattgtattatagttatgtacggtattaaaataagtggtataaaggatatgaggtaataatttgtattaaatttgtaattttttgtaagtttataattagataaaaataaagttgaataatagtttattatttttttaataaattatttattttattttattatggtaaaaagaaatatatgtttaatgtagtaaatattttatatatatataagtaaaaagaagaaaatgaaaattttttaatttaattagttagaggtatttttattaaatatttaggtatatttttattaagatgtgtgtatatggatatatagtatgtatgaattttaattattgattatatttgtaaatgtaaaattttatatttttttattgaatttaattttttttaaatttttattttgtttaatggtaggtaatttaatttagttatttttgaatagtttagttattttaagatttaaagttatttaaatttagtttttagatttagtttttttcgttttatttattagggaggttatatttggattttaattatttaatgtagttatatattgtagatgtaatttattttattttatcgttggggattagtattttgtttttgtttgttagaattataattttgataatgttttttattttttttagggttagaggtttataaggttatttcgggtttttttaatagagttatattagttattttgatttttttattgttttggtatatttttagtttgtaaggttttttttgagatttgtagaatattgaggttattttttgggaaatgtggtatagttttttttttttgtgtaatttatagaaattttgttagattttttagtattttttttttgtgtagattggtttagtgtgatggtattttaggttttttttttaagatttatttaagggatttattttgtaaatttttttgtttgatatttttgaaaatataatataattgaatttttattttttttggagtgaaagaagcgaataaataagtaagtttttatattattttattttttttagtttatgagttatgatataagtttaaaagtttttgtattgaagttagatttttagatatttagattttttttttaaagtttttttttgttgtttggtttttgtttttatattaatggttttaaaattttattttgtaaagtgttaaaaatttttttttttgagaaggagtttcgttttgttgtttaggttggagtgtagtggtttgatttcggtttattgtaatttatgtttttttggtttaagcgatttttttgttttagttttttaagtagttaggattataggtgcgtgttattacgtttgtttaatttttgtatttttttagtagagttaggtttttattatgttggttaggttggtttcgaatttttgattttaggtgatttatttaattcggttttttaaagtgttgggattataggtgtgagttattgcgtttggttagttttaagtttgaaagagttatgtttttatatttggaattttttttttgtttagtgagtatgatttttttatttttataaaatattaatttgagtaatttttggtatattttttaagaatttatttaaaatttggtatattaaaagttgaattgtattgttatttgttttaatatattttaagaagaatatataataattaaaataatttgaaatgttattgtttttattttttttattaattttggttaaatgaaataatatattgttttaaattttattgtttatttatggtttatgattagagattattatagtttatttacgataatgaataaatgtgttttgaaaagttgattatcggtttggtacggtggtttatgtttgtaattttagtattttgggaggtcgaggcgggcggattatttgaggttaggagtttaagattagtttggttaatatggtgaaatttcgtttttattaaaaatataaaaattagttgggcgtggtggcgggtttttgtaatttcggttatttcggaggttgaggtaggagaatcgtttgaattcgggaggcggaggttgtagtgagttaagattatttttattgtattttagtttgggggatagagtaagattttattttaataaaaaagaaaaaaaaataaaaaaaagaaaaaagaaaagttgattatttaatattattgtgttgataggcgtgtaatatggatttttttgtgacgcgtaagtattatttggtagttatatggtgtcgtttgtgtagttgggcgttattattagttttttgttttgtgcgattaaaaggttagtttcggggatagtagtttttttaacgtaaagcgattagttttgttaggcgtcggttgtagttggtttaaggttgacggttttagggtcgtatttttttttcggttattttagattttggaaagagagttatggagggttttagagcgtttttttgtagttttttgaggaaaataagggttttttttttttggttggagtagttaagtgtttacggggaaaatggtttcgtttattattttaggtaaacgtttttatagttgtaataaatatgtgatgggttttttgtattaagaaaggaaaattttttttaaaaataataaaaagaggtggggaggggattttaagttttatttaagattttttaaattcgttgtgttttatgtatacgttgaggtttaatatgaaaatttggagcgaaagtttttacggtttattatagggaatgaagtaaagtatttcgtcggtagttttaggtttcgtaaatcgtggagtttttttagtataaggttttattatgtgttatattagatgagaagaaaataagaggaaggatacggtagagtttttagaatggggtttagttttaggattcgtaggataaaggaaggtcgttttttttcgtttgaggtagggaattaaataaaatatcggtatcgtaggtatcgtagtcgtatttttggggtttcgtggttttttcgcgcgttcgttttgggggcggggaagaattcggatggaattatttttgtagttcggatttttcgtcgtttttgaatggtagcggggcggagttgtttttttttttgtgttttgattggtttggtttcgtattttttttttcgtgattgggtttttttagtgttagttatagagcgacgttggttttttagattgttgtagaaggagacggcgtcgacgtttgattggattcgcggcgatttattttttagtcgtgcgtttttgattcggcgttcggaatttgttttcggttttagggttgcggggtttggaaggaggcgtatcgaggcggttcgaaaacgatttaggggagtcgaggcgttttttttgttattttatttagcgttatgttttggatgtttaagaggtgaagggggcggagggggtggggcgttcggtttaacggtttggaggcgtttttaaatgaatttgattttttcggcgtttttttgcgttttttgggcgatttgtgtagttgtattcgttttgttggtcgtatatgtggtcgtcggagaaataaatgtattgttttcgttggcgagtaggggtttttagggcgagtttcgtgttagggatttgggaaatttttgttatcgattgtggggggtttggggtttaaagtatttcggttagtgttttatttaataaaatatttattagatatttattgtgcgttaggtattgtgttcggtggagggtcgagtaagatagtttttgtttttaagtggtttatagtttatttgtatgtatagacgtgtagataagtatttgtagaggcgttagtagagatatgcgttatttgtaaggaaaacgtatcgtaaataagcgattgtttttaggagaatggaaattttttgtaatgttttagtagatttttttttattttttattgtttaaattggtatttatggttattttcgaaatagttatatttaatgggtttggggttatgtttaaatcggcgacggaaggcgggtacgggtggtttggggttaattttttacggtggcgtggtttggatattagaataggtgttttgttcgtagggagttatagtgatggatgttggatgtattttttggaaaattataaataatttttggtatattaatagttgtatttttataagttttttatatagtttaatttttattgaaattttggtatatgattttattttttaaattatttttttgatatggagtttcgttttgtcgtttaggttggagtgtagtggtataatttcggttcgttgtaatttacgtttttcgggtttaagtgatttttttgttttagtttttcgagtagttgggattatatatgggcgttattacgtttggttaatttttgtatttgtagtagatagggttttataatgttggttaggttggttttaaatttttgattttaggtgatttatttgtttttgttttttaaagtgttgggattttaggcgtgagttatcgtattcggtttataattgtagttatagatattatatatatattaatttagatgatttttattgggaaagaggttagtgaattttgattaggttttttattttgaatatttagggggtaggtagaagagttaatattgaaaataggtagagtttttagaagttttttttatttattgtaatttttgttttaacgagagtaattattaatttttatcgtgatttttatgtaagattttatttgttgaagtaaagtatgagaaaattatttatatggtttttggaaatatttaaatattatattgtttttttttgtttttaaaaaaaaatagg

SEQ ID NO: 196 - DNA, 6620 bp, Artificial Sequence
  chemically treated genomic DNA (Homo sapiens)
tttatttttttttaaaggtaaagaaaaataatataatatttaagtatttttaaagattatatgagtagtttttttatgttttattttagtaaatgaaattttatatgggaattacggtaaagattaatagttattttcgttaaagtaggaattgtagtgagtggagaaggtttttaggaattttatttgtttttaatattggtttttttatttgttttttaggtatttaaaatgaaaagtttagttagagtttattaattttttttttagtgaaaattatttaaattgatatgtatatgatgtttgtaattataattatgggtcggatgcggtggtttacgtttggaattttagtattttgggaggtagaggtaggtggattatttgaggttaggaatttgagattaatttggttaatattgtgaaattttgtttattataaatataaaaattagttaggcgtggtggcgtttatatgtaattttagttattcgggaggttgaggtaggagaattatttgaattcgggaggcgtaggttgtagcgagtcgagattgtgttattgtattttagtttggacgatagagcgagattttatgttaaaaaaataatttaaaaaatgaaattatatgttaaaattttaatagggattgagttatataaaagatttataaaaatataattattaatgtattagaagttgtttataattttttagaaaatatatttagtatttattattgtaattttttgcgagtagaatatttattttggtatttaaattacgttatcgtgggaaattggttttaagttattcgtattcgtttttcgtcgtcggtttaagtataattttaaatttattaggtgtaattgtttcgggaatgattataaatattaatttggataatgaaaagtgaaggggagtttattggagtattgtaaaaagtttttatttttttaagaatagtcgtttatttgcgatgcgttttttttgtaagtggcgtatatttttattagcgtttttgtaaatatttatttgtacgtttgtgtatatagataagttgtgagttatttggggataaggattgttttattcggttttttatcgagtataatgtttggcgtatagtgggtatttaatggatgttttgttaaataaagtattggtcgagatgttttaagttttaggttttttatagtcggtgatagagattttttaagtttttaatacgggattcgttttaggagtttttattcgttagcgaagataatgtatttattttttcggcggttatatatgcgattaatagaacgaatatagttgtataaatcgtttagggaacgtagaggaacgtcgggaaggttaggtttatttggggacgtttttaggtcgttagatcgagcgttttatttttttcgttttttttattttttgaatatttaggatatggcgttgagtgggatgataagaggagcgtttcggtttttttggatcgttttcgagtcgtttcgatacgtttttttttaggtttcgtagttttgaagtcggggataaatttcgagcgtcggattaggagcgtacgattgaaaggtaagtcgtcgcgagtttagttagacgtcgacgtcgtttttttttgtaataatttgggagattagcgtcgttttgtgattggtattaggaaagtttaattacgaagaggagagtgcggagttaaattagttagagtatagaagggagggtaatttcgtttcgttgttatttaaagacggcggggggttcgggttgtaagggtggttttattcgggttttttttcgtttttaaggcgggcgcgcgggaaagttacgaggttttaggagtgcgattgcggtgtttgcggtgtcggtgttttgtttgattttttgttttaaacggagggaaacgatttttttttattttacgagttttaagattgaattttattttaaaggttttatcgtatttttttttttattttttttttatttaatgtggtatataatagggttttatattaaaggagttttacggtttacgagatttagagttatcggcgagatattttattttattttttgtggtgaatcgtggggattttcgttttaaatttttatgttaagttttagcgtatgtatgagatataacgagtttggaaaattttaaatggaatttagagttttttttttatttttttttgttatttttaaggaaaattttttttttttggtgtaggaaatttattatatgtttattatagttatgggggcgtttgtttgaaatggtggacgggattatttttttcgtgggtatttggttgttttagttaagagggggaggtttttgttttttttaaggaattgtagaggggcgttttgaggttttttatggttttttttttagagtttgaggtgatcggaaggagaatgcggttttgggatcgttaattttggattagttgtagtcgacgtttggtagggttggtcgttttgcgttgaggaggttgttgttttcgaagttggttttttaatcgtatagggtaggaagttggtggtggcgtttagttgtataggcggtattatgtaattgttagataatatttgcgcgttatagagaggtttatgttatacgtttgttagtataataatattaggtggttagtttttttttttttttttttttgttttttttttttttttattgagatggagttttgttttgttttttaggttggagtgtaatgggggtgattttggtttattgtaattttcgtttttcggatttaagcgatttttttgttttagttttcggagtagtcgggattgtaggagttcgttattacgtttagttaatttttgtatttttagtagagacggggttttattatattggttaggttggttttgaatttttgattttaggtgattcgttcgtttcggttttttagagtgttgggattataggtatgagttatcgtgttaggtcggtagttagttttttaagatatatttgtttattatcgtaaataaattgtagtgatttttaattatgaattatggatgagtaatagaatttgaaataatgtattattttatttgattaaagttgatgaggaagataaagataatggtattttaaattattttaattgttgtatgttttttttgaagtgtgttgaggtaaatggtaatatagtttagtttttagtatgttagattttaaataaatttttggaaaatatgttagaaattgtttaaattgatgttttgtaagagtaagaaagttatgtttattagataaagaaaaaattttaaatatgagaatatagtttttttagatttaagattggttaggcgtaatggtttatatttataattttagtattttgggaggtcgagttgggtggattatttgaggttaggagttcgagattagtttggttaatatggtgaaagtttgattttattaagaaaatataaaaattaagtagacgtggtggtacgtatttgtagttttagttatttgggaggttgaggtaggagaatcgtttgaattagggagatatgggttgtagtgagtcgagattaagttattgtattttagtttgagtaatagagcgagatttttttttaaaaaaaaaggtttttaatattttgtaaaataaaattttaaagttattggtgtgggggtagggattaggtagtagggaggggttttaagagaagaatttgaatatttagaaatttggttttaatatagaaatttttaagtttatattataatttatagattgaagaaagtaggatgatgtaagagtttgtttgtttgttcgttttttttattttaaaggagataaaagtttaattgtattgtatttttaagaatgttaggtaggagggtttgtagagtaaattttttaagtgggttttagagagaagatttagaatattattatattgggttaatttgtataaagggagaatgttagaaagtttagtaaagtttttgtagattatataagaaaaggaagttatgttatattttttagagagtggttttagtattttgtagattttagagagaattttatagattagaaatgtgttaaggtaataaaggagttaaggtgattgatgtggttttgttaaggggattcggggtagttttgtgagtttttagttttgggaagggtggagggtattattaggattatggttttagtaaataaaagtaggatgttggtttttaacggtgaggtgagatgagttatatttgtaatgtgtgattgtattagatgattggagtttaaatataatttttttggtgggtaagacgaagggaattaaatttgaaagttgaatttaaatgattttaaattttaaaatgattgaattatttagaagtgattaaattaggttatttgttattaggtagaatgaaggtttaagaaaaattaagtttaataaagaaatataaagttttatatttgtaaatatagttagtgattgaaatttatatatgttatatgtttatatgtatatattttgatgaagatatatttagatatttaatagaaatatttttagttggttaaattagggaatttttatttttttttttttatttatatgtatataaaatatttgttatattaaatatgtatttttttttgttataataaaataaaatgagtaatttattaaagaaatgatgaattattatttagttttatttttatttaattgtagatttatagaaaattataaatttagtataaattgttgttttatattttttatgttatttattttaatatcgtatataattatagtataatgattaaaatgaggatatgaatattggtataatattatttttgaattatttttttaaataattaagataatgtagtggaaaagaaaatataatattttgtgatttattaaatttttttataattaggtttttttagattttggataaaattttgagtaaaattatagttgatagggttaaagtgatattaaattaatgttaagtaaaaatttttttaattaaataatataatgaatatgaagtgttgttttggagtaagtatttagtaagtgtttttattgttgtaatagagttattgtttaacgagttttttagtatttaagaaatatggttgattgaggtttattttttttattgaggtttaattagtagggttgtttttaaatagtagaataatattgtttttagaagttagttatttttttaggtgtacgtttttgaagtagattgaattgttttattaagcggtaggagatattttaattttaatttcgcgtttgagaaatttgtggtgttttagattatatagtttttttttaggagataattgttttttttttttttaggttttgatttattaaatgtttttatgtggtttaagtttagggttgtaaggtattaggttagttagggatttgtttttttttttgttttttgtttagggttttttttttagttttagggaagtattattttaggttttggaatgatttagggtttttgttatggttatattaaagtaatttttttattttaatgaaaattgtaaggattaataaatattttttttgttttttttttttttttttttttttaagatagggttttgttttgatgtttaggttggagtgtagtggtataaataagtttattgtagttttaaatttttgggtttaattgatttttttatttgttttttaagtagttgggtttataggtatatattattatgtttagttaattttgtttgttcgttttttttttggagagataggttgtttaggttggttttgaatttttgggtttaagtgatttttttacgtttttatttcggttttttaaagtgttgggattataggtatgagttatacgtttaggttttttgttttttttatggttagaatattaaaattttaattttaaatgtttttttgatataagaaatattatttttttttttttttgataagagttttgttttgttgtttagattggagtgtagtggtgcgtttagtttattataattttcgttttttgggtttaagtaattttcgtgttttagtttttcgagtagttgggattataggtgtacgttattacgtttggttaatttttgtgttttttgtagagatggggttttgttatgttgtttaggttgtttttaaattcgtgcgtttaaatagtttgtttgttttagttttttaaagtgttggggttacgggtatgagttattgtatttagtttagaaagtgagtaattatatcgtagtagtaatttattggttttttttttttttagaaaataggttttattatgttgtttaaattagatttaatttaggttgttttattaatttagttttttaaggagttgggattataggtatgggttattttatttggttgtaaatgattttttaaaattattattataatttattaaattattgtatcgtatggtaatatttatgttaattttaaaattaaggtttaatttgttaatttgttattttaaatagttttttagaaagttaagaaaaaaattttataaa

SEQ ID NO: 197 - DNA, 7823 bp, Artificial Sequence
  chemically treated genomic DNA (Homo sapiens)
aattttaaatttgtttttatttttgataagttttattaaagtttattaaatttttgtttttttatttgttaattggagataattatgatatttaattttatggagtgttgtgaggattaattaaaataatgtatttgaagtttttggtattatgtttggtatggaggtatatgattatgatttgtaaattgtaatgtttttgagatggtagtagagggagtagagttaatgggaattggattttagaaaattagtaagattgatattaaatttttttataagataatgtttttgttttgatggagttagagtaatttgtatatagatgagtcgatgagatttatattaggttattttattttaataatttttgttgttttatttatgtggtattagtatatgtaattagggaatttaacgtatttttttgcgtgtatatattgtttgtttaatttttaattttagtttattttagtttttttagaatatttaagaggggagaggagaagtatggtgatattataaaattgaaattagtaaatgtttatattttttgtataaaaattgggagaaggtggagttggtttattttttttatagcggtaagagtgatattttttttttttttttttttgttttttataaaagtagttttattgggtagagtgggaaaagtataattagaatcgattttgaatttattttattttttatttataattgtgaatttgtttattttatttagattttttttatttttattttcgttttgtatagtaaggtggtagggaagttggagggttaatttggtgagtgttaaagttatttataatttgtttattattttattattaatagttattgatttagtatttaatttgattttattttttatattatatttttgattttttttagtaattttaggtgggatataatatttttatttttatagatagggagttttggggttagagaagttaggtaatttatataattttgtgttattagaaattgatatattagaattagaagttatttttttgaaagtttttaatttgggattttttttttagtatgatgtagtaaaaaattagatatagggtttattattagggtaattgggtggttgtttgagaaaggagataggaatttgtgggggtttttgaatttggaaaattttttaggggttttattttagtatttggtttgttttttattttatttcgaatttttttatgtttttgtttttgagggattgataaggttagggttagtgtagggttaagaaattgtagatttgtttatttagttttgattttaaaaaagagaaataaattggatatagaagcgtttttttttagatgtttttttttatttatgaaatatagaaggaagatagaggtttaaggtagaagatttaattaagaaaaaagtgcgtatttgggtagagagttttttatgatagatatttttggataaacgagttatagttggtagtatatggtaaatagagtagaggttttttaagtgttatttgtagatttttgggagtggttttcgagatttttttagagtatttgtaaggttaaattatttttataataatattaatatagttttgtttttttattttgttgatatttgtattaatggtattaaagtaaaggtgggtgaaattgttggggttttagtataaagtaaggaagtggtgttaaattatattagtagttgtatattttattattatgtatttataataaaatgttagtttgatttaagaatgtttttgatgaagtagtaaaaattattaattttattaaattttagattttaagtatacgtttttttaatattttttgtgatgaaatggaaaaggtatatattaaaggatgatggttatttcgaggaaaagtatttgcgtgattgtttgagttgttaagacgagtttgttattttaaggaaaataattggtagtatttgttgttaataataaaattgagtttttaagtaaaaattagaatttgagtttgattgttttttagtatttaaaatatttatatgatgagattaatattgatattatttgatatgaatttttgaatattgtatgatgaaatgttgtatttattgtatgatgaagtaggtagtatttagaaaatttgtatattttagtggattaatgttttttaaatgattagtgtttgatattgtaaaataatttgtgggtaatagttttatttaaaatatatataataaaagatttgaatgtaatagtatatataaagtatatgtttatataaagtatatataaagtatatgttgataaggttttagattttataatgtaattagttttttagaaattattatttattgagttttgatgtggtattaaagaagaataattatttgaaaaggttattataatattttttttttttaattatataaatgtgtgagtttatattttttttaaatatgttaattaaaataatattttgtagtagattaaatgtagaaatagatatgagaatttagttgtttttttttaaattagatattaaagagatttttaaaatgttattttttttattacgttttttatgttggaagatatatttgttttttttaaaatatgtttaatatggagtgggtttattattgttattttgaaggaataaatatatattttaatttttttttagatttaagttttaatatagtaaataaaaattttatttagaatagtaatatataaatattttttgggtttgttaataatttttaagggaataatggtattttgagaataaaaggtttaaaaattgttgtggaagtcgtaaggtaaggttttgaaaaggaggaggagaataaattttgttttgtatagtaggtatttaataattgaatatgataatgataaggatatgtaaaattagtgtgattaatattatgaggtaggaagtgaaaagtgttaaataagtggtttagatgtgtattgtttaatacggtagttattagttatatgtggtttggaatgtggttagttttaattgatatgttttgtaagtgttaaatatatattagattttagagattgagtatgaaataaggaatgtaaagtattttattgataattttttatattgattatatgttaaaatgttaagatttttgtatatattgggttatttataatattaaaattaattttatttgtgttttttttttttttaatatggttatgagaaaatttataattatatatgtggtttatattttattttttttggagagcgttggtttggataggaagtatgaagaatttggagtagggaaatattgttgtgggtttaggttatcgggaagtttttattgagaattataggattttattaagtaggtaggtttagggaggaatatttagttgaagaaagtttcggtagtgaaatatgaggttaatttgggtagttgaggtgattgtttgggttatattatgggtttttataggggagaaaagttttttggataggttgggattaaattgtatagaatttaaattgttaagaatttggattttttttttataggtagtgatagtttttttagaagaaaattagattttgtttagtagtttatggaatagtttgaaattggtatttttttatgtagggttagagtagtataagtttttggaaattgtttgtttaataagtagtggggattaggtttatttaattaggaaatttatagtgatatggaaagtgtgattttggattgattgatttatttgggggtgggtggtaagtttaagtatatgataatgttatttgggagagaagaatttagagggtgtatttgtgtgaaattcgttagggaagagggaggtaggttttttattttggtatattgttttaagtatgtgtataattaaattgagtgatattttttattttttttttagtttgtttgtttgtttttatttttgtttttgttttattatttttatttttttaaatatttttattgattttttaatatacggtgggattttattgtgttgtttgggttggttttaaatttttgggtttaaggagtttttttattttagttttttaaagtgttaggattataggtgtgagttatacgtttggatttttttttattttattgaatttttattgtgaattaaggggttaagagttaattataaggagatgaaatgaaaagattattgaagtgggaagggaaatatttgggttattatcgggtttcgtggttaatttattgagtttttttggttattttattgggtttttttagatatgaaagaggatttagtattagatgggattaagattttttttaattttgtgattttagaataggttgatgttataaagggagaagaacgtatcgtagtaattaggggtaaggttatttaaggagagtaggaggaggttaggttaggaagggtaagtattggtggtttatttaggatttggtttaattttttgggttaggttattttcgtcggagtgagcggatttcgttggaattggagtttagtaaggtttatgagtttggtgttttgattttggttatttattttttttattttaggggtggtttattaggttgagtggagttttatattagggagagaggaagttgaagaattgggttttaggtaagtaattttgtagaggattttagattgtttaaggaaattattgaagaaaatgtatgtttcgtttttttttttttttttggtattgttgagttatttgtagttgcgagagtcgttgggagggataagagggaagaggacgttcggtgaaggggttttagtttggtagtttttgcgtgttagtatttttagaatagagtgggtgggaattgatttaagtaaagttttagagattcgaatattgacgtataggaaagttttaagtgggaggagaaatgtaaattttttattgatgatggcgttagcggtttttttttagggattgtgaggggcgtttttgattttggatttgagtattgtttgggatttgtgttgagagagcgttaggtaagtggttagattatattttttggttgttttttgtaaggaggatatgtttattatgtaggatattttgaagttttgtttttttttggcgttttgataattgttttattttaatttttttgaggaggtttattatagaaggaagcgttcgattttacgatttatagatgcgttttggtacgggtttttcgcggaaatcgtttcgtaggttcgcgttacggtgttcgggcgaatttttttgcgggggttaggggagttgcggcggttgcggaggtgtgttttcgcggaggttgaaagtgagtttttttttatttttttagttagtttttttagagttgtgatgtttgattttagattagcgtatttggattttagaaaaaagtttgtagttacggtagtcggtgattgtggttttgatgggcgcgagtgatattttagggtaggttatttttttttgtaagttataggttatagagttaaagcggtattattagtttatagacggtgggataaaatgtttttttagtgggattttttaggaaatgtacgtaaaaaggatagataggtattgagtttttagaagtaacgttatagtttttatgagaaagaagtagtttttagagagtgaaagtaaagaaatttgttgaaggatgtttaaaggcgtttttagaggttgtaatagaaaatgttttaggattatgtatttttttttttttttttttttagttttgaatttagtttttcgaaagatttagattttagtagtgatttttttcggtgtttatttttattttttttaattttttttttatttttatttgatatataattgtaaatatttatggaatatatagtgatattttaataaatatgaataatgtgttatgattaaaggatatttagtatatttattattttaaatatttattattattttgtgttgtgaatatttaaaatttttttagttttttgaaaatatatattaagttattgttaattatatttattttagtgttatagtattagaatttattttttttatttatttgtaagttttagttagaaaatagattttttatttaaattatagcgggggtttaataatagtatgatgaaaaattgtaatgttatttttaatttatgttttttgttgttattaattaaaataaattgatagataggataatgttgatagtagtatgagaataaatgttttaattttgtgtggaatatatatatattcgatggaatatatatatattcgatatttggaaaaataaatggtttagatttaggaaattttaggttgttttttagaagttttatatattaggtaggcgttatttcgtttatttgatttttaagttttttttttttaaagttgatatattatttatatttatttattatatttatagtaatgttaggagtgttatttattttttatttaataagtattgattgagtatttataatatgtttagaattgtaaagtgtaaaggtttttataaatataaaatgatatgtaaataaaatattatttttttttttatttgttttttttttagtaaaatattggtaatacgtttttttataaattttaagttatttattaggagtttagggaaaaggtgtttaaaatgattttatttaaaatttaaagaatatgtatatgaaatatatgaaattattttggtgttttataggtaaaaggaaattttagtttatttatgagatatgttgaaatgttatggtgattaattatgtaaaagggggtttggtgtttttatttgatttagaattgttgagaaaataattaaaaatttgattttggaaaatataaaatgttgtaattttaaggaggtagcgttatattaatttttttgagttaggaaatatgtttatagtttttaaattggttagagtggggttataagggggaaatgcgtattttttttttatgataggttgttaaataggtattaagtgtggttttttattttttaagtaatttgagggtttaattattattagatgttttttagagataaaaagattatattttttaagagttttgtttatttataatggatttttatagagagaaatgaaatatatttattggtttagaaatatttttaatttaaaaaattggagtttacgaaaatgtatatataaaattttttatgaagttaagataaaattggattagaagttaagaatataaagttgattttagaagttagataaatttgaaataaagaaaaaagaaatttggtaattttatataaaagaagttttttggggggttgttttttatatataaagttttagagggttttaggaggtatagtaaatgttaaatacgtttgtttttaagttgttttaagtttaaatgttgaggggataagagatagggaaagagtttgttgataatagaaatttatatagatagttgtgggtaggatgtggggtgtttggtagagtgggagtgaaaattttttggagtaggtagaataggagtttattttagagtaaggaaggttgtagtttaggggtatagaaagaaggttgttttttttattagggttgaattatgaaaaaaaattttagtgaaatttttgtatttttggatatattggaatttagttataatattgattaattttaaggaaagaagaaaatatgtattagggttatgaataatattttaaaattttaattttatatttttttttatagt

SEQ ID NO: 198 - DNA, 7823 bp, Artificial Sequence
  chemically treated genomic DNA (Homo sapiens)
gttataaaagaaggtgtagaattagagttttaaaatattgtttatagttttagtatatatttttttttttttttagaattagttaatgttatgattgaattttaatatatttaaggatataaaaattttattaaggtttttttttataatttaattttaatgaagggagtagttttttttttgtgtttttaaattatagttttttttgttttaaaatgaatttttgttttatttgttttaaaaagtttttatttttattttgttaaatattttatattttgtttatagttgtttatgtgaatttttattattaataagttttttttttattttttgtttttttaatatttagatttggagtaatttgaaggtaaacgtatttgatatttattatattttttaaaattttttaagattttatatgtgaggaataattttttaagaagttttttttatatgaaattgttaaattttttttttttttattttagatttgtttggtttttagagttagttttatgtttttgatttttagtttaattttgttttagttttatgaagaattttatgtatgtattttcgtaggttttagttttttaaattaaaaatatttttgaattagtgaatgtgttttatttttttttgtgaggatttattatagatgggtaaagtttttaaaggatgtagtttttttgtttttgagaaatatttgatagtggttaaatttttaagttatttaaggagtaagaaattatatttgatatttatttggtagtttgttataaaagaaaagtacgtattttttttttgtaattttattttggttaatttagaagttgtagatatattttttaatttaggaaaattagtatgacgttgtttttttgaaattatagtattttatgttttttaaagttaaatttttggttgtttttttagtaattttaagttaagtaaaaatattaaatttttttttatatgattaattattataatattttaatatattttatagataggttaaggtttttttttgtttatagaatattagggtaattttatatattttatatatatattttttgggttttaagtagaattattttgagtattttttttttgagtttttggtaaatgatttaaaatttataaaaaaacgtgttgttaatgttttgttaaagagaaagtaagtgggaaaagaagtaatgttttatttgtatattattttatatttatgaaaatttttatattttataattttaggtatattgtaaatgtttaattaatgtttgttaaatgaagaatgagtggtatttttgatattgttatgaatatggtaggtggatataagtagtatgttaattttaaaaaggaaaaatttgaagattaaataggcgaaatgacgtttgtttaatgtgtgaggtttttaagggataatttgaggttttttgagtttgaattatttgtttttttagatatcggatgtatatatattttatcggatgtgtatatattttatataaaattggaatatttgtttttatgttattattaatattgttttatttattaatttattttagttaatgataatagagaatatgagttgaaaatagtattatagttttttattatattattgttaaattttcgttatgatttggatgaaaaatttattttttaattaaaatttataggtagatgggaggaataagttttagtgttgtaatattaggatgaatatggttaataataatttagtgtatatttttaaaaagttaagaggattttgaatgtttataatataaagtaatgataaatgtttgaggtgatggatatgttgaatattttttgattataatatattgtttatatttattgaaatattattgtatattttataaatatttataattgtgtgttaaatgaaaataaaaggaaaattaaaaaaaataaaaataaatatcgaaaaaaattattattaagatttgagtttttcggagagttgaatttaaagttgaaaaaaggaagaagaaggaatatatagttttaggatattttttattgtagtttttgggaacgtttttagatattttttagtaggtttttttgtttttattttttaggggttattttttttttatgaaaattgtgacgttgtttttgaaaatttagtgtttgtttgttttttttgcgtgtattttttagaagattttattaaaggggtattttgttttatcgtttgtgagttggtggtgtcgttttggttttgtggtttgtagtttgtaaaaggagatgatttgttttaaaatgttattcgcgtttattaaagttatagttatcggttgtcgtagttgtaagtttttttttgaaatttaggtacgttaatttaaagttagatattatagttttagagaagttggttaagaaagtgaagaggggtttatttttagttttcgcgaggatatattttcgtagtcgtcgtagtttttttggttttcgtagggagattcgttcgggtatcgtggcgcgggtttgcggagcggttttcgcggagaattcgtgttagggcgtatttgtgggtcgtggagtcgggcgtttttttttataataagtttttttaggaaggttaaaatgaagtaattgttaaaacgttaagggaaagtaaagttttagagtattttgtataataagtatgttttttttataagaggtagttagaaggtgtggtttggttatttatttagcgtttttttagtataggttttaggtagtgtttaagtttaaagttagaagcgttttttatagtttttaggagaaagtcgttgacgttattattagtaggggatttgtatttttttttttatttgaggtttttttgtgcgttagtgttcgagtttttgggattttatttgggttagtttttatttattttattttagaaatgttaatacgtagaaattgttaggttggagtttttttatcgggcgttttttttttttttattttttttagcggttttcgtaattgtaggtggtttagtagtgttaggaaaaaggggaggggcggggtatatattttttttagtggtttttttagataatttgagattttttgtagagttatttatttggagtttagttttttagttttttttttttttagtataaggttttatttagtttggtgaattatttttgggatggaagggatgggtagttaggattaaaatattaaatttatagattttattgggttttaattttagcggggttcgtttatttcgacgagggtgatttgatttagagggttgggttaagttttgggtaggttattagtgtttgttttttttgatttagtttttttttattttttttgagtagttttgtttttggttgttacggtgcgtttttttttttttgtgatattagtttgttttagaattatagagttggaggaagttttggttttatttaatgttaaatttttttttatatttgaagagatttagtgaggtgattaagaggatttaataagttagttacggagttcgataatagtttaggtgtttttttttttattttagtggtttttttattttatttttttgtagttagtttttaattttttgatttatagtaggggtttaataaaataaagagaagtttaggcgtgtggtttatatttgtaattttagtattttgggaggttgaagtggaaggattttttgagtttaggagtttgagattagtttaggtaatatagtaaaattttatcgtatattaaaaaattaataaaaatgtttaagaaagtaaaaatagtaaaataaagataaaaataaagatagatagatagattgaaagaaaggtagaaagtgttatttaatttggttatatatatgtttagagtaatatattaaggtgaaaggtttgttttttttttttttgacgggttttatataggtatattttttggattttttttttttaggtgatattattatgtgtttaaatttattatttatttttaaataggttaattaatttaaagttatattttttatattattgtaaattttttggttaggtaggtttggtttttattgtttgttgagtaggtagtttttaggagtttatgttgttttgattttatataagaaagtgttaattttaggttattttataagttattaagtaaagtttgatttttttttggagaagttgttattgtttataggaaaaaaatttaaatttttggtagtttaagttttgtatagtttggttttaatttatttaggaaattttttttttttataagagtttatgatgtgatttaagtagttattttagttgtttagattaattttatattttattatcgaggttttttttaattggatatttttttttgagtttatttatttagtgaaattttatagtttttagtgaagatttttcgatgatttgaatttatagtaatgtttttttgttttaaattttttatattttttgtttaaattagcgttttttaagagaaataaaatgtaagttatatatgtaattgtaaatttttttatagttatattaaaaaggaaaaaagtataggtgaaattaattttaatattgtaaataatttaatatatataagaattttaatattttggtatataattaatataaaaaattattaataagatattttgtattttttattttatatttaatttttgaagtttggtgtatatttagtatttatagggtatgttagttaggattagttatattttaagttatatatggttagtggttgtcgtgttggatagtgtatatttagattatttatttagtattttttattttttgttttatagtgttagttatattggttttatatgtttttattattattatatttaattgttgagtgtttgttgtataaaatagagtttgtttttttttttttttttagggttttattttgcggtttttatagtagtttttaaattttttgtttttaagatattattatttttttaaaaattgttgataaatttaaggaatgtttgtgtattattgttttggatgaaatttttatttattgtgttaaaatttaaatttgagaaaaaattaaaatatgtatttatttttttaaaatgataataataaatttattttatgttaaatatgttttaagaaaaataaatatattttttaatatgaaaaacgtaatgagaagagtggtattttaaaaatttttttaatgtttggtttgagagaagatagttggatttttatatttgtttttgtatttaatttgttgtaaagtattattttggttgatatatttgaagaaagtatggatttatatatttatgtagttggaaaaggggagtattataatgatttttttaaataattatttttttttgatattatattaaaatttaatgagtggtagtttttgaagggttagttgtattgtgaaatttgaaattttattaatatatattttatgtatattttatgtaaatatatattttatgtatattgttatatttaaattttttgttgtatatattttgaatgaaattattatttataaattattttgtaatgttagatattggttatttaaaaaatattggtttattgaagtatgtagattttttaaatgttgtttattttattatataatgaatataatattttattatatagtgtttagaaatttatgttaggtaatattaatgttgattttattatgtaagtattttaaatattgggaagtagttaagtttaaattttaatttttgtttgaaagtttagttttattattggtagtagatattattagttgttttttttaaagtgataggttcgttttggtaatttaaataattacgtaagtgttttttttcgagatgattattattttttaatatgtgttttttttattttattataaagaatattaaaaagacgtgtatttaaggtttgagatttaataaaattaataatttttattgttttattaaaaatatttttaagttaaattggtattttattgtaagtgtatggtggtgaaatatataattgttagtataatttggtattatttttttgttttgtgttaaggttttaatagttttatttatttttgttttggtattattggtgtaaatgttagtagggtgaaaagataaaattgtattagtattattataaaaatagtttaattttgtagatgttttaaaaagatttcggggattatttttagggatttgtaggtaatatttagagaatttttgttttatttgttatatgttgttaattgtaattcgtttatttagagatgtttattatgagggattttttgtttaaatacgtattttttttttggttaaattttttgttttgaatttttgttttttttttgtattttatgagtggaggaagatatttaagaaagggcgtttttatgtttaatttgttttttttttttagaattaaaattaaataagtaggtttgtagttttttgattttatattggttttggttttgttagttttttagagataaagatataaaaaaattcgaagtaaaatgaagaataaattaaatgttaaaatgaaatttttggaaggttttttaaatttaaaggtttttatagatttttgtttttttttttaaatagttatttagttgttttggtgataagttttatatttaattttttgttgtattatgttaagaagaaaattttagattaaagatttttagaaaagtagtttttagttttggtgtgttaatttttagtggtataaagttatataagttatttaatttttttaattttaaaattttttgtttataaaagtggggatattatgttttatttgaaattgttgggaaaagttaaagatataatgtaagaaatgggattaggttaaatgttgaattaatagttgttaataatagaataataaataagttatgggtaattttggtatttattaggttaattttttagtttttttgttattttgttgtatagagcggaaatggagatgaagagagtttgggtgggataggtaggtttatagttgtaaatagaagatagggtggatttaaaatcggttttgattgtgttttttttattttgtttagtggagttgtttttgtgggaaatagagagaggaagagagaggatattatttttgtcgttgtaagggaggtaaattagttttatttttttttaatttttgtataaagaatataaatatttgttagttttagttttgtgatattattatattttttttttttttttttaagtgttttgaggaaattggggtgagttggagttggaggttggatagataatatgtatacgtagaaagatgcgttgagttttttggttgtatatgttagtattatatgagtgggatagtaaggattattgggataagatggtttggtgtgaattttatcgatttatttgtgtgtaggttgttttagttttattagaataggaatattgttttgtaaaagggtttaatattaattttgttaattttttgaagtttagtttttattgattttgttttttttattgttattttagaagtattgtaatttataaattatagttatatatttttatgttagatatagtgttaagaattttaaatgtattgttttagttaatttttatagtattttataggattaaatattatgattatttttaattggtagataaggggatagaggtttagtgagttttagtgaggtttattagaggtaaggatagatttgggatt

SEQ ID NO: 199 - DNA, 4604 bp, Artificial Sequence
  chemically treated genomic DNA (Homo sapiens)
aacggtttaaggtttcggttttttttttttttttttttttttttttggggttttttttttttttttttttatgagatagtttcgtttcgttgtttaggttggagggtagcgatattattttgttttattgtaatttttattttttggttttagttatttttttgttttagttttttgaggaattgggattataggtgtatgttattatatttggttaatttttatatttttagtagagacggggttttattatgttagttaggttggttttgaatttttgattttaagtgatttatttgttttggttttttaaagtgttgggattataagtgtgagttatcgtgtttgatttattttaagttttttagaatttgattttttttacgtttaataaagagtaagtattggtttaataggattaataaggattaattttttaggtgtttttgagttaaaaaaaaaaattggttcgtttgtgtgttattatagttttagttaaaatatttaataaagttttatttagttgtgtttattttaattaattaagtgtgtgattttggttaagttatttaaattttttgagtttttattatttagtggagttataaggtatagtggtttatatttgtaattttagtattttgggaggttgaggtagaagaattgtttgaggttaggagttttagagtagtttggttaatatagagagattttgtttttataaataattaaaaaaaaaattatttaggtatggtggggtgtatttgtataggttttagttattcgggaggttgaggtgggagggttatttgagtttaggagtttaaagttgtagtgagttgagatcgtattattgtattttattttgggtaatagagtgagattttgttttaaaaaattttttaaaagattaaaaatataatttattggggttattaataattaaaaagatttgggttaatattttgttattgttgttatttgtgtttttattttggataagtatgtttttttttttataaattttatttttttttaaagatgggggttttgttatgttgtttaggttggttttgaatttcggggttgaagtgatttttttgttttagttttttaagtagttaggattataggtatgtgttgagtttttgggtaagtaaattaagatttttgagttatatttgtttttttttattaaagagtattgttttagttgttataataaaatattataatttagatggtttaagtaatagaaatttgttatatttttggagtttagaagtttgagattagcgtgttagtatgattgggttttggggagggttttttttttttgcgtttttgttgtgtttttatgtggtggagagagagagaattttttttttttataaggttattaattttattatgggggttttgttttataaattttatttaaatttaattattatttaaaggttttttttaaatattattacgttggggttataatttttaatatatgaatttgggggtgatattatagatattaatgtttattttatagggtttttataaggtttaaggtaggtattaatataggaaagtatttaaagttgggtttggtttgggtaggtagtttaatgatttaataaatattgagtatttatttggagttaagtattgtatgtgttatatgaagcgatattgggaaatgagttatatgtagttaatttttggttttttggaggttttgaattagaaggggatacgtatataatcgtatgtgtgtgtatttatatatataggtgatatgatgtatttgagagaatttagtttaggaattaggaaaatttttaaggagtgatattttagttgtattttgaaggatgaggaatggagaggaggttaattttaggttttaaagtgaatttttgcgtaaaagttatgaggtagtaaggtgtaggggtttttaatgatttaagggaacgtattgtggggttgggattatgatggttagaggaggttttgataagaggttagttaaagagtagagaaaaattttaaggagttttaagaaagggaagtgttacgatgagttttgtgtttggaaatgttttaggcggttatatcgtagtttcgggattggttgggatttggatagatatttggatattagttagaaagttacgataggaaattaggcgaggacgaggtaattggggatgttgtggagtagagacggagagaaaatgggtgtattcgagataagttagggggaaaaaatgtaaggatttggaaatgaatttggggcgcggtaggaaggtatgacgggttgttttgtaggttttatttgtaaattacggcgattagtgaaagatttggaggaggaaggtggatatattttttaataaaaaaaattttttttgaaattttatattaatattttaaaagtaaattagatttttttagatatgtttttgagttgatatttgttaattagttagaattagaaattttttttatttttatttagttataatatacgttatagttgaggtgagaggaaagaaaaggttgtttttttaggaataaagagtggtatttttagtatcgtgggtaaagtttttttaagtttaatagtagttaaaatagcgttttttataaataatatttagttaaaagtttttgggtttgtgattgttttaacggttaagttcggatgagggtttttggagtcgtagttttcgggaaacgtcgattggttttttatttggattttattcgtttaggtagtttagagcggttttaggtcgttcgtttttttgttaattatagtttcgcgattgcgtttagtttttaggtttcgtttttcggttaagcggcgtgtttttattgtacggcgtttgggtttcgcgcgtcgggatttcggttttagtcgttttgttttgtttcgaggtttttaggttcgtttttgggtttcgcgcgttaggatttcggtttcgatcgttttgtttcgtttcgaggtttttaggttcgtttttttgttttcggcgtgttttcgcggtttcgtttttaggattcgcgcgtcgggattttggtaagttttagtcgttcggtttcgttttttcggttttacggttttcgcggttttttttttaagttttatacgtcgggattttggtaagttttagtttttagttttatttttaggtttcgtttattcggttagcggttggttttcgcggtttcgtttttgtgttttgcgagtttttattttgggagtattgcggtcgtcgtgtttcgtttttttttagcgcgcgtacgtttttttgcggttcgtcgttttagacgcgggaagagtttggtcggtttcgagtcgttggtttgtagtttttttgtgtttttcgaggtttttttgttttcgttttgcgaggagttttttattcgaaggcgggacgatgtcgaataatcgatagtcgaggaatcggtagtcgagaaatcgtttcgggaacgagtttcgttttcgttcgttatggaatcggatggtcgcggtgtttgggtttatagtcgcgtcgcgttcgatcgtttggagaagattgttgtttgttcgcgttggtaaagacggagttttttgggggtggttgcgagggtacgcgtcgtatagtttttgggggcggtagaatttttttaaatttttcgtttttttttttcgttttcgcgttgtagtcgggtcggcgtgcggttagtacgtgtcgggggatatagtattaataatttttgttttttatttattttatttttgggcgatttatcggtttttttttgttttgaatttaattgaaacggtagtttttgaattttagcgggttgaagaatcgtttggaggtgtggttaaaaaaatgtttatttcggtcgcgtttttagagtttgaatcgggttggggttggggttgaggtttttgtattttttattcggttttggattatttcgttgtttttcgggagttgtggcgaattgggttgtcgggtcgtttcggagattttttaaattagaagtagttgttattttaagttaaattggtttttttgatatttttttcgtgttagttttttcgagtgagatgggatggagtatcggatatttattatagttgtagattgaagatggtacggaattttttatttttttagtttgtttaaaagattgtatgtttggtgttttcgtttttagtgatgttgtttattgtttttttttatgttgttatattatgggagtttttttagggtttttatttcgtttaaagatatttttatgagtgttattttttgttttttttcgtgtagttttttttagtatataaattaagaaggtttgtaaaatttaagaaaggtttgttttatttttattttttttgaaaagtatttttattgagtatttgttgtgtgtatagttaagtatttttgtatgaagattattggtagtttttttgttatttgtagttgttaaaagtttatattttttttggattttttttttttttgatttttaatttgtagaatttaagttatttagttgtataaagtataagtaatataattttttttttttttttttttttt

SEQ ID NO: 200 - DNA, 4604 bp, Artificial Sequence
  chemically treated genomic DNA (Homo sapiens)
aaaaaaggaaagaaaagaaaaagttgtgttatttatattttatgtaattaggtaatttaagttttgtaagttagaaattaaaggggaaaaaagtttaaaaaggatataaatttttgatagttataaataataaaaaaattgttagtgatttttatatagaaatatttagttgtatatatagtaagtgtttaataaaaatgttttttagaagaaatgaaaatgagataaattttttttgggttttataaatttttttggtttgtatattagaaagagttatacgaaaaaaagtaagaagtaatatttatgaaaatgtttttggacggaatgaaaattttgagaggatttttataatgtgatagtatgaaggaaaataataaatagtattattaagagcggggatattagatatatagttttttgagtaaattaagaaaatgagaaatttcgtgttatttttaatttataattatggtagatattcgatgttttattttattttattcgaaaaagttggtacggagaaaatgttaaaaaggttagtttaatttagagtggtagttgtttttaatttagagggttttcggggcggttcggtagtttaattcgttatagttttcggaaagtagcggggtaatttagggtcgggtaaaaaatgtagaagttttagttttaattttagttcgatttaaattttggaggcgcgatcgggatgaatatttttttagttatatttttagacggttttttagttcgttgaagtttaaaaattatcgttttagttggatttagggtaaggggaggtcggtaagtcgtttaaaaataaagtgaatgagaagtagaagttgttaatattatatttttcggtacgtgttaatcgtacgtcgattcgattgtagcgcgggaacggaaggaggaaacggaagatttgaaaagattttgtcgtttttagaaattgtgcgacgcgtgttttcgtagttatttttaagaagtttcgtttttattaacgcgagtaggtagtagttttttttaggcggtcgagcgcggcgcgattgtgggtttaggtatcgcgattattcggttttatggcgggcgggaacgaggttcgttttcggagcggtttttcggttgtcggtttttcggttgtcgattattcggtatcgtttcgttttcggatgaaaggtttttcgtagagcggaagtaaggaagtttcgggaaatatagggaagttgtaggttagcgattcgaaatcggttaagtttttttcgcgtttgggacggcgggtcgtagaggggcgtgcgcgcgttggggaggggcggggtacggcggtcgtaatgtttttaaaatagggattcgtagggtataggggcggggtcgcgagagttagtcgttggtcgagtgggcgggatttaggggtggggttggaggttgaaatttgttaaagtttcggcgtgtgggatttaggggaggggtcgcgagagtcgtgggatcgagggggcggggtcggacggttgaaatttgttaaagtttcggcgcgcgggttttaggggcggagtcgcgagaatacgtcggggatagaggggcgggtttaggagtttcggggcgggataggacggtcgaaatcgaagttttggcgcgcggggtttaggggcgggtttaggggtttcggggtaggataggacggttgaaatcgaggtttcggcgcgcggggtttaggcgtcgtgtagtgagagtacgtcgtttgatcgaagggcggggtttgaaggttgagcgtagtcgcgaggttgtagttggtaggagagcgggcggtttgaagtcgttttgggttgtttggacggatgaagtttaggtggaaagttagtcgacgtttttcgggagttacgattttagggatttttattcgagtttaatcgttggaataattataaatttagaaatttttagttgagtgttatttataaaaagcgttgttttgattgttgttggatttggaaaagttttgtttacgatattgaaggtattattttttgtttttaagaaagtaattttttttttttttttattttagttgtggcgtatattgtaattgagtaaaaataaggaaagtttttaattttaattagttaataaatattagtttaaaggtatgtttgaaaagatttggtttatttttaaaatattggtataaaattttaaaaagggttttttttgttagagagtgtgtttattttttttttttagattttttattgatcgtcgtaatttatagataagatttatagagtaattcgttatgtttttttgtcgcgttttaagtttatttttaagtttttgtattttttttttttaatttgtttcgaatgtatttatttttttttcgtttttgttttataatatttttagttgtttcgttttcgtttggttttttgtcgtagttttttagttgatatttaagtgtttatttaggttttagttagtttcgagattgcggtgtggtcgtttaaaatatttttaaatataaaatttatcgtggtattttttttttttaaaattttttaaagtttttttttgttttttgattagttttttgttaaaattttttttggttattatggttttaattttatagtgcgtttttttaggttattaaaagtttttgtattttgttgttttatggtttttgcgtaaagatttattttggaatttggaattggttttttttttattttttattttttagaatatagttgaagtattattttttaaaggtttttttagtttttagattggatttttttaggtgtattatattatttgtgtatgtagatatatatatatacgattatgtgcgtgtttttttttagtttaaaatttttaaaaggttagagattggttgtatgtgatttattttttaatatcgttttatgtggtatatgtagtgtttggttttaggtaggtgtttagtgtttgttgaattattgaattatttatttaagttagatttagttttaagtgtttttttatgttaatatttgttttaagttttatagggattttatgaaatgggtattagtatttgtagtgttatttttaaatttatatattaaaagttgtaattttaacgtgatagtatttggaggggatttttgggtggtagttagatttagatggggtttatgaggtagagtttttatgatggggttaatgattttgtaagaagagagagttttttttttttttattatatgaggatatagtaagaacgtaaaagaagagggttttttttaaaatttagttatattggtacgttaattttagatttttagattttagaaatatgataaatttttgttgtttaagttatttagattatagtattttgttataatagttaagatagtgttttttaataagaggaggtaggtgtggtttagagattttaatttatttgtttaagggtttagtatatgtttgtagttttagttatttgggaggttgaggtaggagaattattttagtttcggggtttaaggttagtttaggtaatatagtaagatttttatttttagagaaaagtaagatttgtaaaaagaaaagtatatttgtttaggatggaggtatagataataatagtggtagaatattaatttagatttttttgattattaatggttttagtaaattatatttttggttttttgaggggttttttgggataaggttttattttgttgtttaggatggagtatagtggtacgattttagtttattgtagttttgaatttttgggtttaagtgatttttttattttagtttttcgagtagttgggatttgtgtaggtgtattttattatgtttggataattttttttttaattatttgtagagatagggtttttttatgttggttaggttgttttagaatttttgattttaagtaatttttttgttttagttttttaaaatgttgggattataggtgtgagttattgtgttttgtagttttattaaataatgaaaatttaaggagtttaaatgatttggttaaaattatatatttggttagttagaataagtataattaaataaggttttattaaatgttttaattgaaattatgatagtatataaacgaattaatttttttttttaatttagaggtatttaagaagttagtttttattagttttgttaagttagtgtttattttttgttgagcgtgggagaaattaagttttagaaaatttaaaatgggttaggtacggtggtttatatttgtaattttagtattttgggaggttaaggtaggtggattatttgaggttaggagtttaaggttagtttggttaatatggtgaaatttcgtttttattaaaaatataaaaattagttaggtgtggtggtatgtatttgtaattttagttttttaggaggttgaggtagaaaaatagttggaattaggaggtgaaggttgtagtgaggtaagatggtgtcgttgttttttagtttgggtaacggagcgagattgttttataaaaaaaaaaaaaaaaaaaattttaaaaggaaaagaaagaaaaggaaaaggatcgaaattttaaatcgtt

SEQ ID NO: 201 - DNA, 12968 bp, Artificial Sequence
  chemically treated genomic DNA (Homo sapiens)
ttttttgtgatttagtgttgttattaatatataaggttgatagagtaattttaaatttataatattatatgtagatatttaaaggaaagaaaaagagttttatgtgattttgtttaatgggtttatttatagttgtaaatgtatattgtaagtgatttatatttgggaattattatgtaataattatttttaataataattgatataatttattagaatttgtgagaggtttcgatgtaaataatttatttgtttagtagagagaagggaaggagagtaagtaggggaaaatgtttttaaaatgttttattattggaagtaaatgattataaatgtttttgcgttaagttagggtttggttttaatttttttttgaattttaatgtttttatattttttaaatatattttaaatttttattaaataaattatattttaattatatacggagtttaaaagaggtgattttatgatagatatttagtattagttagtgaaggagaatattggttgaaggtatttaaaattacgtgtataaggaatagtttattttttatttggtgatttattattttaagttatttttgtgttaaagttataaaaatttttagtgttaaaaagtgtaagaagaaatgagttagtaaaaaaaaaaaagtcgggggaaagttaatttttaaatttgtattatttttatttttttattttttgttattttagaatgtatatttggaatgaatttttttagagacgtttacggtatgttaaattttaagttatatttttaaataaagtatatatttttatagatgtgtatatgattttatatttatgtatttttatgtataatttgtgatataatttaattaaataattaaggttgtttttgttgattttaatatatttaaaagtagttttttatattgtaaatgttatattatataaaatattttaatgaaagtttaaatgatatttttagttttatagcgtttattataggtgtattttgatgttattaaatgtttttatataattttttaaaaataaaatagagtttggttttttttatagtttagtttattatttgtgttatagtagtggtaatgtaagatttttatgagagtaaaatgtttattaagtatttttaaattttaaaaagattaattttaaaatgtttttagtttgttatttgtgaggtatataatgggtttatgaagtgaaagtgaaattattatatattaattatagtattttatagaaatatttagatggaggaaggatgtaatggaagaattaagggtttttttttttttttttatagtaattagatttgaaaagtgaagtaattttaaagttattttagaagaaaaaaatgtttaattaaattttaatgtttaaaattggatagtgtgtatggtaggtgatttgtatatatatgttattttttattaaaattgttttttatttttgtgatattaatataaattgtagttatttggttttaaattatagtaagatatattttattttttaaaatgtaaatggttatttaaaatagaaataatttttttagacgtattgtatttttataaatgtgattttggaaatatattgttcgtaaagggtaattttaagagaattgttgagattttaattttatttttatgtatattttggggaggtttttgaaagagtaaaaaggtaaaagatttagttattttttgagattatttatagttttttatttaaagttgtagaagaaaaacgttaatgtattgttattgttttttaatgaaattattttttttttaattaattaagtagtattttttaaatttattgtagaaatgtatattttatttttgttgtgagtcgtttttaattttttttttttttttttttcgtaataaaatttggaaaaatttgttacgtagtattcgtttaacgtatcgtttcgttgtattttttttttttttaattttgtattatgataaaagtaaattttagtattattttagggaaatattgggaatgaatttggtaatgttttttttttttttttttttaggtaaaggaaggggaattttgtattgtcgttaaaatgagcgtttttggtggaaaggaattttttatttcgtatacgttgtggttgtttttgaaagtgtaggtttcgtaaaatgttcggtcgattaaggggtttttttttttcggagtttttgtttttttttatttattttagatttttagtaaggaagggtagaggttggtttgttttttttttttaagagggtatcgcgttgcgtagttaatagtttgcgtcgtttcggggaaatttaaatgtttcgcgattttatcgagttaaggagtaaaagttgtgattgttattagttttttgtcgggttttaaattcggggtttatcggttgaaatttttagttgagtagtttttacgacgttgtttttgacggttaaattcggtgtatgtaaggttgggattaattttttttattcgataaaggaatttgatttttttttgggagatcgtagttcgagttcgattcgtagttttcgtcgcggggtttagggttttaggtaagcggttcgagatttagaggagtttttttggattttttcgaggggtaaattattcgagtttgttattttttttggagttaaaagtttatttttggagtcgttatattttcgtgttttttttcgtatttcgggggtttcgggggatgtacgtgggggtggttttaggagttttgggtgggatttcggggaaatgtattggagattaggcgaaaaggttttttttgtttagaatttgtttttagagcgggtcgcgttcgaattcgtaggtaaaggcgttgcggtttttgcgggcgggcgggcgcgcgcgatgtattttttttagggatagagttagaaagtggacgtttgggcggggggagggggggatttataattggaattaggtttaaaaaaattattttaaaagaaaaatgtagtaagtttttttttcgagattttaggtttattaaaataaaattgaattcgggtgttggtagtgtttagggggagcggaggcggagagggttgaggtcgcgggtcgttcgttttagtttttcggaagttcgggtttttgaagtatagatagttaagagcggttcgagttaagttttaggaataggggtttcgggaagagatttcgatcgggtcgtatagcggggaggtttggttcgagagtttttatttggtcggttgcgattttatattggaatttcggaaacgcgttttggtcgttttagtttaagtgggttttggggcggttttttgttttttattttcgaacgttagtttttttcgggcgattcgaaggttacgaggcgggtcgtatagtttcgcgtcgtcgggggcgtttcgggagtttcggggattgcgcgcggcgtttagggagggcggttgttgttttttggcgttcgttagagttcgcggcgcgtttcgatagtttcgcgtagttcgggttcgttcgggaaaggtttttacgttagttaatttcggtttttttttgcgttcgggttcgcggtaacgttcggggatagtttttgcgcggtagcggttatagtattttagttttgggggagggaggagcgggcgttaggggtttcgtgaggtcggcgagggattttcgcgtcggggagtttaattgaggggtttcgcggggattataaagtagttcgcggtggaacggggtcgggattcggggattgggttgtagtttcggggtggatgagaggtttcgggaggtgtagggttcggtagggagggcgtggagggatttatggtgacgggagtagttttcgttgggagggagtttcgtcgggcggggtcggagttggtagcgtacgtcggatcgggggcggggtttttcgagtttcgcgaaaatgttcgtagtatcgcggggatcggcgtagggggaagcggtcgttcgtacgcgaagtcggggtgggtttcgtatttggggtcgttcgagcgtacgggggcggggagaggagcgggggtcgttttcggggagtcggaggggagacgcggggttcgggtaggttgttcggttgttgcgggtgtcggcgttataaggttcgggagtaagtcgcgtggttgtttttaattttttttttagtcgcgcgtttttggggttttttttgattaggaaatttttcgttggtcgttgacgtacgtagtaagtgagacgcgcggagggatcgagtcgcggttcgggcgtagcggtaaaaaatatttattatagaaatcgatttaagggaagacgttgagagtaaacggtacgcgcggacgtcgttcggttttatgtaaggaattagcgtcgtttcgtcgtagttgttagtcggacggtgtaggagcgcggagtggttttttcgggtttcgcggttaaatcgtattttcgttttggaagcggaggtttggttttgggcggtcgcgtaggatttggggtcgttcgcgggttgtagttcggttcgggagtttcgtggcggttattgcgtttgtttgtagcggttcgcggggtcgggttttttcgggtgcggcgcgtcggtcgggtttttttcgggtcggcggggtttgttttttttttttaggttttcggatcgtggttattcgcggagtcgtataagtttgcgtgtggttgcggaaaggggttcgtacgcgggcggggtttcgggttagtatgtaggtttggatgcggggcgcgggggtggttttcgatttttcgttcgggttgcgtatagtagcgcgcggcgcggcggcgggggcgcgcgggttaattttaggagtcggcggcggcgagtcgcgttttggttgatatcggaaaggtttgtgattggtcgtcggtcgtttttatgtaaacgagttgagggaatggaattttttcggtcgggtttatagtaaaagtacgtttatttttaggtatttttatttatagagttagcgggcgcgggcgggacgggcgtttcgcggtcggatttagttagggtattacgttgttcggttttgcgtcgttaggtattttttttcggggtttttagggacgttagaaggaagttaatttttgttgtttttttttggtttgcgttggatttttttttttttgttgtttttttttgtttttttttttttttttttttgaattaattggttttttggttggatgtttttaattttttttttggttgcgaatttttttttaattgttttttttttataatagggggagaaagtgttttgtggttcgaggcgagtcgtgaagttgcgtgtgcgtggtagtgtgcgtggtaggatgtgcgtgcgtgtgtaattcgagtcgttcgatttgtttcgatttgcgtcgcggagtttttttttaaggttcgttttatttgttgcggttacgcggcgttcgtgggtgttcgtgtttcggagtagttaatcggcgggtgttgggcgacggtggaggagtatcgtttcgttgttgttcgagttagggttgagttatttagttgatgtagatagtggttgtttttcgaagagtgcgtgtttgtatgtgtgtgattttgcggttgtttaatttttaataaattagaggattagttataaatttaattaatatttttaaattcgagtttatagatgtgggagagttgtagaattttgagtgttatcgattgggtttttttatgattgttgttttaagattagttgaagatttttgaaacgttgaattttttgtattgagcgttttgatagaatttattgagagaatagagaatatgataagtatttttagtttagtattgttttaattattgaagttgatttttaaggttatttaaaaaaatttgtagcgtatattaatggatttttgttgtgtttaaattttttatagattgtattgtaaatattttatgaagtagagtatatgtatatatttatatatacgtgtatatatattagtagtattatttttggaagttttagtttttgtttttcgggattgaagttagttttgtatgataaaagtggttttgttacgggagataattgtgttttgttgggattttagataaaatttatttgtaaaaaattgataggtattaattattggaatttttaaataatgtgtttgttgatcgttttatttttcgtataaatattttaggaagtgtatgagaattttgtttttaggaatttttttaatagttaaagatagaatttaatttttgtaagtaagattcgtggaagatagtttttattttttaatgtattaagtaatcggttgttaggagtttattttgggttagaggtcgattcgtagaattagaacgttttttttttttggattgttagtaatttagtttttttttttttttaattattttcgtttttttttatttttcgtagtaataaaggtttttgaacgtgtatgttggtttttcgggagttgtttgttgaagattcgcgtttttgtcgtcgtttggtaggagttgtttgtagggttttaatttaatcggtttgttgtgatgcgtattttcgtagatgttagtacgagtcgtcgttttacgtcgttttttatcgcgttgagtttaggtaagatgagcgaggcgttgtcgttgggcgtttcggacgtcggcgttgttttggtcggtaagttgaggagcggcgatcgtagtatggtggaggtgttggtcgattattcgggcgagttggtgcgtatcgatagttttaattttttttgtttcgtgttgtttacgtattggcgttgtaataagattttgtttatcgtttttaaggtattggttcggagagggtggtgggaggataggcggaggtcggcgaggtcgggggagattcgcgagggtagcggttaggcgggcggggtcggattttggaaaggggttttcgtagtttcgggtcggtttttttagtttgggatgtgggggatgttgtgttgtcgtggcgattttcgggaggtattcgttttagttttttggggcggttttttaggagggttgaaaatattagggtgtttttaaagatatttattgggagtcggtcgggatttttttggtaggggttttagttttgatataaagtaggaaaagttataatttagttcggtagagatagttcgtttgttaatttattgttgtttttatcgttggattaatatttaaattattttgttttttttagatgaaaggattaggaaataaaatagtaagatttttttgtttttaagttagtgaaaagaaattaattagggaaattgttagggattttttttttttttttttaatcgttttataggaattagtatgtttaaagtttatagcgggcgtagttaagtttgtaaaagttttttgaagagttttttgagttttttagtttgtttttgttagaagtcgtaagtatcgaattttgttttttttttcggaatcgttttgaatgttattattagtttatttagattaagttaggggtagcgaaaggtgacgaggttgttttcggagagttaggggttttagcggttcgtttttttgttagaggagggggcggcgcgtagtcggagattttagcgcggcggttttaaagatttttttttattttttatttttgattatttttaaagttttgagttgtttttaaaaattttgatttttaataggggtatgaaaataattttaggcgtttttaaataattattttattatattagtagtaagtagtaggaatttaatttttgtagtggagattttgttttgtttttggtgggtttgaaaagatgcgattaagtaaaattagtgcgggttattttttgttcgtttaaagggcgaattaaggtaggtggttttaagtgtaaagataagttattaaaaaaaaagtttaaataattgttttttttaaagggagattaatttaatataagttttttatagttttaagttttagttgggttttgattttattataacgacgaatatttattttttaaaaaagtattgttgcggttatttttaagttttatatagtttttatatttagattgtgatttttaaaataaaacgaaatttgtagttggttgtgtttatagattggtttttttttttatttatttttttaaaagtagttttttttgtttgttttgttttttagtgggggtggaaatgaggagaaggaacgaaggaacgtggtggtttgtttgattttttttttttttttttcgtttatttagatttgggtttgggagattattttatttttaaattattttaattttttgtttaaatggatttagcgatgattttttagggtattcgtattgagaggggatttaatagggttgggttatggggttattattagataaagagtagaggtaagacgggttgataattattaaaggttattaaaatttggttgttttaatgtattagggttttaagagatttgtggtttttttttgggggggaaattagggttttttttgaatttttttttttgttagggaatttatatttaaatatattaaaagattaaatgattaataaataatttttaggaattggagtaatttagagttttaagttattatatgaaagtatttatttttttttaaaaaatgaaaaattatatatattgtttttatgagttgttagaattttttttagtagaaattataataattatagagttttttttttaaaatgatttttggtaatttatttaaaaataattaatttgttttattgagtgataatttataggttattaaaaatttaaatatagagtttttgaaaaaagtttaagtagattttttgagaatatttaggggaaaggaaaggatagtagagaaattagattatttgattattgtttgttattattttaatttttataaaaagaggtttttttttggaggagatttgtttattgtataattagaagagtagataaaatgtttagtgagatagtaaacgtgaagggataaaatgttagggataaaagtaagtaaaatattaaaatttgtttatatttcgggtttatttagtgtgtgtttttggttttattttatttgtttatttaattattttataagtagttttaatagaaattattattttaaaatttggattttaaataagtcgtaggtaatttttttaggaagttaattagtaaataattattatattttttatggtaaagagaagtaaatgtgaaataatgataaggtttgatgatattgatgaaaagattattgaaggtttttttaggaattttttgaagttttgtaggtaaattttttacgttaattttttgaattaaagagagatttaaaattatgaattttttttaaaatagattataataattttatttgtttattttgagttttaatttgttttttttttatttttttttttttatggaatatttttattttttatagtatgagagatatatgttttttattattaagaaaattttaagtttgttgtgtgttttgttgtatttatagaattagtttaaaaagttgttttgatgatttaggatgtatttggtaatattatggtgttatagtttgtttaggttttggtatattagagtttaaagacgtaaacgtgtttttagtagggaagttcggaggttttggattttgatggtaatattttttttataaaaaggaaataagtaatatttttgtcggtaagattatagtttttagttatgttttaaatattattttagttgaattttgtgttttattttatagttttttttgtaatattggaaggttaacggatttgaagtaaatgaattgtaattgtaattttaatttaattagaattggtttaaaatgttagtttggatcgtgaataggttagttaagaatagtattgggaggtttatgtaatatagaagagagttgatatttggtttaattttttgatattttaaaaatagagaagtaaaataaaatatgagatatttttggttagtaagtttttttttgtttgtttggtttgtgttaaaatgtaaatgtttgtgtttttttatttattgtttatagttttttattttagttgttttttttttttgtttgaagttagatatttttatattttttttatattgtttattagtgataaaatttgtattaaattagtacgtatgttagttttgaattaaaaagaaattttttaaatttggtttaagtatgtttgttaataattggacgatatatagtattaatgaattgttttggatttattagtttttttttatttattcgtttttattaaaaaaaaatttttagagattaatataaggttaagtgaatgatatgtaggtgtttaaatatggttgattttgttgtatttaaaaaaaaagaggagtgggagttaaatttttaatttttttttttttaagttttaatattaatagtttttttttatttagtttttatgataattttattttatgtttgtttcgatttggcgaaggttttttgaatttgttaaattattaatgaggatagtattggaaagatgagagaggtataggtttggagtattgtgaggggaatagtagtaggaggtagataatttagaatatatttttgtagttataaaagaagatttatttatttttatttttttatagatttagatttaataatgagttatttagtttgaaatttacgtagtggaggtagtttttgtatatttgttgaatgttgagttataatagagaagtttgggttattatagggagaggaggatgaggaagtaaaaatatgtgtttaaagagggtattttaatattgtgagttaattttataacgggaagtgaaaattatgaaaaaaaggggaaaatttgttgtgagagattaaaaagagtaaaataaagtaagtttatttttcgggaatagaaaaaaaaaaaaaatagtagtaataattaaataattgattagggagatttattttcgtgatatttttttaaaataaaaagggaattgtcgtattattgtttttaattaaatggtaataaatatatttataatgggaattaaatagttaattagagggtgtttggggaataaatagtagagttttaaaattttttatatggaaaatatgtttaataattggaatgaaaggattaaaaagagagaaaaggtttagattttgtttggtagtgtaagttggataaaatagaggaaaatgtttttttgtttttatgagattagattattttggtgtagttttggggttggaagtatgtttattttttatagtgagttagttcgtgttttgtgttataaggattgaagtagttttaatgaataaaaataatagatagttatttggaggttatagggaaagggtgatggttaagtagattatgaaaatgggaattttgagaaatatgatttcgatattatataagtgagtttatggtagttttttttatatatagaaaaagaggtttgaaaatatatattataaaaaattatgtagtagttattaaggtaaaaattgggaagtaggaggtagaggaaggagtgataatattagattaaggaatgttttattgttattaatttaaaaatagtaattaaaaatgatgatgtaattggaatgagtaatataaatgttattattgattttatcgtaaagaatgttagaaatgattagaataaatatagtttggggtatttcgatttgaagttgtatgattgttttgaaaaatagaaataaaggaaatatagttaatagtaaatgtttagattaagaaaatagtttttagaaggtttaaatgatagttaagaaattgatgttattgtataaagtatttttaggttatgttttttagagtattttattttggaatttatttttttaattatttgagtataaaaatatttatttattagttttttttaatagttttgataagattttatatttatttagttatattaaataaatttttggttaagattagttgggttagtagaaaattttaggtatttgtgaggatatgagtttatatacgttgagatttatagatataaaaatgtaatttaattttatttttgaattgaggggagtgtatagaagtgaatgtttcgtttttttgaggtttgttgattttgtaattagtaaacgaagggtgtatttttgattttttttttttgtgtgttagaatttattgttagtaaaatttaagataatagcgatgagtaggaggtattaaagatgaattgtagagggatagtttaagttatttaagaatcgttagtaagatgaaatttatttttagtagaaattgggtttttttgtgtttttttgttttgttttattttttaaaagtaaagtttgtattttgtttagtttgttagtggaggtttgagtaagtaaaagatgggttggattataaatttataaatataggatgttttgttttttaaacgggagaaattaagaagagatgtttgtatttaggagacggtatagttatttaaaatttttgatattttgttatggttagttttgttttaattgtgttatgtgatttattatggttttatgaggtaaatttagtatatgtgttattatttgaaaatttatatatagttatatataatgtattaggttggtgtaaatgtaattgtagtttttggagttaaaaattgtaaatattgtaattatttttgtattaatttaaaatataataaaaaagtgttttttttttataatttttttgttgttttgtttaagttattattgttatttttttgtaatttaaaaagaaattattgaatatatatttaattttagaataattattatataaatgttttaaaagtgtatgtataatatttttgatgtttgtatttgttttttgattggtgtttagg

SEQ ID NO: 202 - DNA, 12968 bp, Artificial Sequence
  chemically treated genomic DNA (Homo sapiens)
tttaaatattagttaaaggataaatgtagatattagggatgttatatatatatttttagggtatttgtgtagtgattattttaaaattaaatgtatatttaatgatttttttttaggttgtagaggaatagtaatgataatttaagtaaaataatagaaaagttataaagagaagatatttttttattatattttaggttggtgtaaaagtaattgtagtgtttgtaatttttaattttaaaaattgtagttatatttgtattaatttaatatattatgtataattatatgtaaatttttaaatagtgatatatatattaaatttattttataaagttatagtaggttatatagtatagttggaataagattaattatagtaagatattaaggattttgagtagttatgtcgttttttgaatataagtatttttttttaatttttttcgtttgagaaatagaatattttgtgtttgtaagtttataatttaatttattttttatttgtttagatttttattaataggttgaataaggtgtagattttatttttagaaaataaaataaaataaaaaaatataaaaaaatttaatttttgttaaaagtagattttattttgttgacgatttttaagtaatttaaattgtttttttatagtttatttttgatattttttatttatcgttattattttgagttttattagtaatgaattttagtatataagaaaaaaaaattagaaatgtatttttcgtttattaattataaaattaatagattttagaaagacgggatatttatttttatgtattttttttaatttaggggtggaattgggttgtatttttgtatttgtgagttttagcgtgtgtaaatttatgtttttatagatgtttgaggttttttgttagtttagttgattttgattaggaatttatttaatgtaattgagtaagtatgaagttttattagggttattggagaaaattggtagataaatgtttttatatttaggtaattaagaaaatgaattttaaagtaaaatattttgaaaagtatgatttaaagatattttgtataatagtattaattttttggttattatttaggttttttagaaattatttttttggtttagatatttattattggttgtattttttttgtttttattttttaaagtagttatataattttaaatcgaaatgttttaagttgtatttattttgattatttttgatattttttacggtaaagttagtagtgatatttatattatttattttaattatattattatttttggttgttgtttttgaattggtaatagtaaagtattttttaatttagtgttattatttttttttttgttttttattttttaatttttattttaataattgttatataattttttgtagtatatatttttaggtttttttttttatatgtaaaaaaggttgttatagatttatttgtatgatatcgaagttatgttttttaagatttttatttttatgatttgtttagttattattttttttttgtggtttttagatgattatttattgtttttatttattagaattgttttagtttttgtggtatagaatacgaattaatttattatgagagatgaatatatttttaattttaagattatattaggataatttagttttatagaagtagggaggtatttttttttattttatttaatttgtattgttaaataaggtttgggttttttttttttttttaatttttttattttaattgttggatatgttttttatataggagattttaaaattttgttatttattttttaagtattttttaattagttatttagtttttattataagtgtgtttgttgttatttaattaagagtagtgatacgataattttttttttgttttaaaaagatattacggaaataaatttttttgattagttatttggttattgttattgttttttttttttttttattttcgaaaaatgggtttgttttattttgttttttttagttttttataataaattttttttttttttttatgatttttatttttcgttgtaaagttagtttatagtgttgaaatgttttttttgaatatatatttttatttttttatttttttttttttgtggtaatttaggtttttttattgtaatttaatatttagtaggtatatagagattgtttttattacgtgggttttaaattgaataatttattgttgggtttggatttgtaaaaaggtgaaaataaataaatttttttttataattataggaatgtattttgaattatttgttttttattgttgttttttttatagtgttttaagtttgtgttttttttatttttttaatattatttttattggtaatttggtaaatttaggagattttcgttaagtcgaaataaatatagaataaaattattatggaggttaaataagaaaaggttgttgatgttggaatttaagaagaaaaaaattagaagtttaatttttatttttttttttttttaaatgtagtagaattaattatatttgggtatttatatattatttatttggttttgtattgatttttgagggtttttttttggtggaggcgggtgggtaaaggggaattagtaaatttagggtaatttattaatattgtatatcgtttaattgttaataagtatatttaagttaggtttaaaaagtttttttttaatttaaaattaatatgcgtgttaatttgatataggttttgttattgatgggtaatatggagagaatgtaaaaatatttaattttaaatagaaaaaagaaataattggaatgaaaagttataaataataggtaaggaaatataaatatttatattttaatatagattaaataggtaagaagggatttgttggttaaagatattttatattttgttttatttttttgtttttaaagtattaggaagttgggttaaatattaatttttttttatattatatggattttttaatattgtttttggttagtttgtttacggtttaaattggtattttaaattaattttaattaggttgaaattatagttataatttatttattttaaattcgttaattttttagtgttgtaaagaaggttgtggagtggaatatagaatttagttgagatgatatttaaggtatagttagggattgtgattttgtcgataaaaatattatttattttttttttatgaaaagaatattattattagaatttaagattttcgaatttttttgttgaaggtacgtttacgtttttggattttggtgtattagggtttgaataagttataatattatggtattattaaatatattttaagttattaaaatagttttttaggttaattttgtaagtatagtaaaatatatagtaaatttaaggtttttttagtagtaaaaaatatgtattttttatattgtaaaaaataaaggtgttttatgggagggaaggagtagggggagaataggttggggtttaaaataagtaagtagggttattgtaatttattttaaagaaaatttataattttaaatttttttttagtttagaagattgacgtagaggatttatttatagaattttaggagatttttaagaaggtttttagtgatttttttattaatattattaggttttattattgttttatatttgtttttttttattatagggaatataataattatttattggttaattttttagggagattgtttgcggtttatttaagatttaaattttaaagtaataatttttgttgaagttgtttgtgaggtggttgggtgggtagatagagtgaagttagggatatatattaaatgagttcgggatgtaggtaggttttgatgttttgtttgtttttatttttaatattttatttttttacgtttattgttttattgaatattttgtttatttttttagttatgtagtgagtaggttttttttaggaagaagtttttttttatgaggattggggtggtgatagataataattaaatggtttgatttttttgttattttttttttttttttaaatgtttttaggggatttgtttgaattttttttaagagttttgtatttggatttttagtagtttatagattattatttaataaaataaattaattgtttttaagtgaattgttaaaagttattttaaaaaggaaattttatggttattatggtttttgttagaaagaattttgatagtttataaaagtaatatgtataattttttattttttagaagaaaataaatatttttatgtaatggtttgagattttgaattgttttaatttttgaagattatttattaattatttagttttttaatatatttgagtgtgggttttttggtagaggagggagtttagaagagattttgattttttttttaaaaggaagttataaattttttagagttttagtgtattggggtagttaggttttaatggtttttggtggttattagttcgttttgtttttgttttttatttgatagtgattttatggtttaattttgttgggtttttttttaatgcgggtgttttaaagagttatcgttgagtttatttaggtaaagggttagaatgatttaaaagtaaaatggttttttaaatttaaatttaagtaaacggagggagggaaaaaagagttaagtaagttattacgttttttcgttttttttttttatttttatttttattaaaaaataaaataaataaaaaaaattgtttttagaaaagtgagtggaaaaagaggttaatttatagatatagttaattgtaaatttcgttttgttttagaaattataatttaagtgtggaaattgtataaagtttaaaaataatcgtaataatatttttttaaaaagtgaatattcgtcgttgtaataagattaagatttagttgaggtttggaattataaaaagtttatattaaattaatttttttttaaaggggataattatttaaattttttttttagtagtttatttttatatttggaattatttgttttgattcgttttttaaacgaataggaaatgattcgtattgattttatttagtcgtatttttttaaatttattaaagataaaatagaatttttattgtagaaattaaatttttattgtttgttgttagtgtagtagggtgattgtttagaaacgtttggggttgtttttatatttttgttgaaggttaaggtttttaaaggtagtttaaagttttggggatgattaggggtgaaaagtgaagggagatttttggagtcgtcgcgttgaagttttcggttacgcgtcgtttttttttttagtaggaaagcgggtcgttgggatttttggtttttcgaaaatagtttcgttatttttcgttatttttggtttaatttaggtgagttgatgatagtatttagaacggtttcgggaaaagaaataggattcgatatttgcggtttttggtaggagtaggttaaaaagtttagagaattttttagaaaatttttgtaaatttaattacgttcgttgtggattttggatatgttaatttttatagggcggttagagaaggggaaaaaaaatttttgatagtttttttagttagtttttttttattgatttgaaggtagaaaagttttattattttattttttgatttttttatttgaggaagataaaatggtttgggtgttaatttagcggtaggggtagtagtaagttagtagacgggttgtttttgtcgggttgggttataattttttttattttgtattaaagttaaggtttttgttagggaggtttcgatcggtttttagtggatatttttggggatattttgatgtttttagtttttttgggaggtcgttttagaaagttgagacgagtgtttttcgagggtcgttacggtaatatagtattttttatattttaagttaggaagatcgattcggggttgcgggggtttttttttagaattcggtttcgttcgtttggtcgttgttttcgcggatttttttcggtttcgtcggttttcgtttgtttttttattatttttttcgggttagtattttgaaagcgatgggtagggttttgttgtagcgttagtgcgtaggtagtacggagtagaggaagttggggttgtcggtgcgtattagttcgttcgggtggtcggttagtatttttattatgttgcggtcgtcgttttttagtttgtcggttagggtagcgtcggcgttcggggcgtttagcggtaacgtttcgtttattttgtttgggtttagcgcggtggaaggcggcgtgaagcggcggttcgtgttggtatttacggggatacgtattataataagtcgattgagttaggattttgtaaatagtttttattagacggcgataggggcgcggatttttagtaagtagttttcgggagattaatatatacgtttaggggtttttattattgcggggggtgggggggggcgggggtggttaggggaggagggagattaagttattaatagtttaggaggggaaaacgttttggttttgcggatcggtttttgatttaggatgggtttttagtaatcgattgtttagtgtattaaaaagtggagattattttttacgaattttgtttgtagaggttaagttttgtttttggttgttagaaaagtttttgaaggtaaaatttttatatattttttaaaatatttatgcgaagagtaaaacgattagtaaatatattatttggaagttttagtagttaatgtttgttagttttttgtaggtgagttttgtttaaagttttaatagaatataattatttttcgtaataaggttatttttattatgtaaaattggttttagtttcgaaaagtaagagttgagatttttaaaggtagtgttattaatgtatgtgtacgtatatataaatatatatatatgttttattttataaaatatttataatataatttgtggagaatttaaatataatagaaatttattaatgtacgttgtagatttttttaagtagttttgaaaattagttttagtagttggagtagtgttgagttagaagtatttgttatgttttttgtttttttaatgaattttgttaaaacgtttagtgtagaaaatttagcgttttagagatttttagttaattttaaaataataattataagaaggtttagtcgatgatatttagggttttatagtttttttatatttgtgaattcgggtttggggatgttggttaagtttgtggttggttttttggtttgttgggagttgagtagtcgtagagttatatatatgtaaatacgtatttttcggaaggtagttattgtttatattagttgggtgatttagttttgattcgggtagtagcgagacgatatttttttatcgtcgtttagtattcgtcggttagttgtttcgaggtacgaatatttacgagcgtcgcgtaatcgtagtaggtggagcgggttttgagggagggtttcgcggcgtagatcgaaatagatcgggcggttcgggttatatacgtacgtatattttgttacgtatattgttacgtatacgtaattttacggttcgtttcggattatagagtattttttttttttgttgtaaaaggaaaataattggggaaaagttcgtagttaggaaagaagttgaaaatatttagttaagaagttagttaatttaaaaggaagaaaggggaaaaataaaaaaaaataataaaaaaaggaaggtttaacgtaggttaaggagaagtagtagaggttgatttttttttggcgtttttaggagtttcggaaagaagtgtttggcggcgtagggtcgggtagcgtggtgttttggttgggttcggtcgcggggcgttcgtttcgttcgcgttcgttggttttatgaatgagagtgtttggaaatgaacgtgtttttattgtaagttcggtcggaggaattttatttttttagttcgtttgtataggggcggtcggcggttaattataggttttttcggtattagttagggcgcggttcgtcgtcgtcggtttttggaattggttcgcgcgttttcgtcgtcgcgtcgcgcgttattgtacgtagttcgggcggggagtcggaggttattttcgcgtttcgtatttaagtttgtatgttggttcggggtttcgttcgcgtgcggattttttttcgtagttatacgtaggtttgtgcggtttcgcgagtggttacggttcggagatttggaaaaagaaagtaggtttcgtcggttcgaggaggattcggtcggcgcgtcgtattcggagaggttcggtttcgcgagtcgttgtaggtaggcgtagtggtcgttacgaggttttcgaatcgggttgtagttcgcggacggttttagattttgcgcggtcgtttagggttaggttttcgtttttagggcgggggtgcgatttggtcgcggggttcgggggagttatttcgcgtttttgtatcgttcggttggtagttgcggcgaagcggcgttgattttttgtatgaggtcggacggcgttcgcgcgtgtcgtttgtttttagcgtttttttttgggtcggtttttgtaatgggtgttttttatcgttgcgttcgggtcgcggttcgattttttcgcgcgttttatttgttgcgtgcgttagcggttagcgaagagttttttagttaggaaagattttaagaacgcgcggttggaaggaaagttgaaagtagttacgcggtttgttttcgggttttgtagcgtcggtattcgtagtagtcggatagtttgttcgggtttcgcgtttttttttcggtttttcggaagcggttttcgttttttttttcgttttcgtgcgttcgagcggttttaggtgcggaatttatttcggtttcgcgtgcgggcggtcgtttttttttgcgtcggttttcgcggtgttgcgggtattttcgcggagttcggagggtttcgttttcggttcggcgtgcgttgttaatttcgatttcgttcggcggggtttttttttagcggaggttgttttcgttattatgagtttttttacgttttttttgtcgggttttgtatttttcggggttttttatttatttcggggttgtaatttagttttcggatttcggtttcgttttatcgcgggttgttttgtggttttcgcggagttttttaattaagtttttcggcgcgggggtttttcgtcgattttacggggtttttgacgttcgttttttttttttttagggttagggtgttgtggtcgttgtcgcgtagggattgttttcgggcgttgtcgcgggttcggacgtaggagggggtcggggttgattggcgtggaggtttttttcgggcgggttcggattgcgcggagttgtcgggacgcgtcgcgggttttggcggacgttagggggtagtagtcgttttttttggacgtcgcgcgtagttttcggagttttcggaacgttttcgacggcgcggggttgtgcggttcgtttcgtggttttcgggtcgttcgggaagaattagcgttcgaggataaaagataggaagtcgttttagagtttatttgagttggaacggttaaggcgcgttttcgaggttttaatatagagtcgtagtcggttaggtggggattttcggattaggttttttcgttgtgcggttcggtcggggttttttttcgaagtttttgtttttggggtttgattcgggtcgtttttggttatttgtgttttaggagttcgggttttcggggggttaaggcgggcggttcgcggttttaatttttttcgttttcgttttttttgggtattgttagtattcgagtttagttttgttttaatggatttggggtttcggaaagaaaatttattatattttttttttaaaatgatttttttaagtttaattttagttgtaaattttttttttttttcgtttaaacgtttattttttaattttgtttttgagaagagtgtatcgcgcgcgttcgttcgttcgtaggggtcgtagcgtttttgtttgcgggttcggacgcggttcgttttagaggtaagttttgggtaagggaaattttttcgtttggtttttaatgtattttttcgagattttatttagggtttttggggttatttttacgtgtatttttcggaattttcgagatgcgggagggagtacgagggtgtggcggttttaaaagtaggtttttgattttaggggaaatagtagattcgggtgatttgtttttcggaaaggtttagggaggtttttttgggtttcgggtcgtttgtttaaaattttaaatttcgcgacgggggttgcgagtcggattcgggttgcggttttttaggagggagttaagtttttttatcgagtaaggaaagttggttttagttttgtatgtatcgagtttagtcgttagaggtagcgtcgtgggagttgtttagttaggagttttaatcgataaatttcgagtttgaagttcgataaaaagttgatagtaattatagtttttgttttttgattcgatgggatcgcgggatatttgggttttttcggagcggcgtaggttgttaattgcgtagcgcggtgtttttttgaaaagaagaaatagattaatttttgtttttttttattgaggatttaaaatgaatggaaagaggtaggggtttcggggaaagggaattttttagtcggtcgggtattttacggagtttgtatttttaaggatagttatagcgtgtacgaagtgaggaatttttttttattaagagcgtttattttagcgataatatagaatttttttttttttgtttaagggagaaaggaaaggaaatattattaggtttatttttagtgtttttttggagtaatgttagaatttatttttgttataatgtaaaattaaaaaaaaaaaaaatataacgaagcgatacgttgggcggatgttacgtgatagatttttttaaattttgttgcggggagagggagggaggagaattgaaaacggtttataataggaatgaaatgtatatttttgtagtggatttaaaaagtattgtttggttagttggaagaaaaataattttattggaaaatagtaatagtgtattgacgttttttttttataattttaggtaaagaattataggtggttttagaagataattaaattttttatttttttgtttttttaaaagtttttttaaaatatgtataaagatgggattagaattttaataatttttttaaaattattttttgcgagtaatatatttttaaaattatatttgtaaaaatgtagtacgtttaaaagaattatttttattttaaatgattatttatattttaaaaaatagaatgtattttgttatggtttggaattaaatagttgtagtttgtattgatgttatagggatggaaaataattttgatgaagagtaatatgtatgtataaattatttgttatatatattatttagttttgaatattggaatttaattaaatattttttttttttgaagtggttttgagattattttattttttaaatttaattattatgagaggggggaggagagtttttagtttttttattatattttttttttatttgaatgtttttgtgggatgttatggttaatgtgtgatgattttatttttattttataaatttattgtgtattttataagtagtaagttgaggatattttaaaattaatttttttaaaatttaggaatgtttagtaaatattttatttttataaaaattttgtattattattgttataatataggtaataagttgggttgtgagggaagttaagttttgttttgtttttagagagttgtatagaggtatttaatagtattagaatgtatttatggtaaacgttgtagaattgagggtattatttaagtttttattgaaatattttatatggtataatatttataatatggagaattgtttttaagtatattggaattagtagaaatagttttaattatttggttaaattatattataagttatatatagagatatatagatataaaattatatatatatttatgaaggtgtgtattttatttaaaaatataatttggaatttaatatatcgtggacgtttttagaaggatttattttaagtatgtattttgaaataatagaaagtaggaaaataaaagtaatgtaagtttaaaaattaattttttttcgatttttttttttttgttagtttatttttttttatattttttagtattggagatttttatagttttgatataaaaatgatttgaaatagtaaattattaaataagaaataaattgttttttatgtacgtggttttaggtatttttaattaatgtttttttttattagttaatattgaatatttgttatagaattattttttttaagtttcgtgtgtgattaaaatgtgatttatttaatgaagatttaaaatatatttggaaggtgtaggaatattagaatttaagggaaaattaaaattaaattttaatttaacgtaaaaatatttatgattatttatttttaatgataggatattttagaaatatttttttttgtttatttttttttttttttttttgttaggtaggtaaattatttatatcgaaattttttataagttttaatagattatattaattattattagaaataattgttatatgataatttttaaatatggattatttatagtatatatttataattataggtaaatttattaagtaaagttatatgaagtttttttttttttttttgaatatttatatataatgttgtgaatttgaaattattttattagttttgtatattgataatagtattgagttataaagag

SEQ ID NO: 203 - DNA, 7038 bp, Artificial Sequence
  chemically treated genomic DNA (Homo sapiens)
tttagaatttttgttttgtttttttgttgtatttttttttatagtgttgattagaatttaatataatttatattttaattattgattttgtttagtgtttgtttttttttaggagaattttagttttacgagaataggaattgtttgttttgtttatgaatgtgtttttagggttagaattatagtatgtgttaaggaatattcgataaatgtgaaggttgagtattgttttttgttcgttggatattttggtttttttcggcggtttgttgatgttttgtgtgtatttattatatttatggtatcggttttttttgattttagagtaagggcgtttagcggatttttacgtatgtgaatggtttttgtagttttagaatttgttatttgggggtagtatatatttaggtaagttttattatcggttttgagtatttttcgtttttaaaattttggattttagaatttcggagtttggtagtttttggggatttatttttgttagttttatttggtagatggggaaattgaggttttagagaggaggtatgatggggaaaattttaaatattggaattagggaatttggtttttaagtttggtttttgtatttatttataagggtataagggggatttggagggggaagtaggaagttttaatttttttcgggttttagtttttttatttgtttgttttgtggggtgaaagggatatttgattaattttaatgtgtcggggaaggttagtagtgaggggtaatagtaggtttagaattttagatagaatattattattttattttatatattagggattgaggtttagaggggatattagatacggtcggagagttatagtatggaaggtatagggtagtatgaaaggttatttttttgttatttttttgttttacgtttattagagatatttttttatttatgttttgatggtttattttttcgttatatttttttatttgttggttgatttttaagtttttttgtagaatattttttgttaaagtagttacgtggatttttttttggtaaatcgttttagttttttttttttgaaaatgggatagggaaaagttgtagagatggggaggaggaattgtgaaaagtagtttgggggtagaggaggacgtgtgttttaggtaggaaagtgtttgtttttttttcgttttcgtttggtttttgtttattattatgtggttacgtgggtttagtttatagttttaggttttaaaagaggagttggaaatttgaattttgatgtgaaattttttgatttttaaatgttggtaataaatttatttaaatatatatatattaagtaaaacgttatggggttaaattgaatatatttgtggtttcgatttggttattggttgttagtttgagatttttttcggttttaggttttgagggtaggtgattgggagaggtggcgttagggggattttggttttttgtgtttatatagttatttacgtattttgggtttttgggtcgtggtggtttaagtttttattatttttattttttggggaaaggttgaatagtattggggtgggggtgggggagtagtaggcggggtttgttgagtaagagttttgtaaaaataagggtttacgttattttagtttgtagtttttttgtaggatatttgggtcggtatcggggtgggatttgcgttgagaagggatgggttatttttagtagggggtggagggtggggaagggtggtaagtatgttttattttagaggttagagggtttagatttttgttggggttgagtttggtttttgggggttggtttgtaaggttcgagtaatattttaacgtattgtgtgattttaggtttatttttttttgtgttttagtttttttatttagaagatgggatttatattgttaggtttgttatgataaatttaagagggaaagttagattggaaagattttatttttttttatttttttatgtgatttggagtagatatatttagtttttttgggttttagtttttttatttataaagtggagataatgataagattgtggtttggcgtagcggtttatatttgtaattttagtattttgggaggttgaggtaagagggttatttgaggttaggcgttcgagaaaagtttgagtaatagagtgagatatatttatttttataaaatattgaaaaatatgaaaaaagaagaagaaaaaagatttgttttttataaattattagtaggattaaatgagttaatatatgtaaagagtttggaatgtggtttagagaaggtggaagtttggtttaagaatatatagtaaattttttaattagttttagtttttttatatttttttgtatttttttagaatttagaaagggaacgtgggcgagtgttttggtttagagaggggagttattttgtttaaggttatatagtttagttaacgaggaatttttttttttttttagttttttttatttatttatttattatttatcgagtattttttatgtattaggttttgttttaggtattagggatatagtagtgaaggtcgtggggatagatagtaagattggtaggtaagataattttgattataatgagaatggtgacggaaatgaagtaggggtgtgagaggagtgattgagggtttagattttttatgggaaggttagggagggtttttcggaggaggtagtttttgggttgagatttgaggagttgttttgggtagaggtggggtgatagtgtttttggtgtatagggaatagtaaatgtatttttttattggtaaatgttgagcgtgttgtgtttaggagtttttcgtgggttagttttttttaagtggtagtttgtagggagattgaggtagatagttaggataatggtggttggcgatagggaaggaaatttattagtaggtgggatagggagggttttttagaagtcgtggtttttagtttagttttgagtgttttattttgtagtgaggaagggttggtcgggtggttttagggaagttgtcgtatttttttgggttttgatttttttttaatttagaggttgttgggaagatttagaaagttagtaggttgggttagtgttttattttttttttttttgttttttatttattaagggtgtttagagatgttatttttttagtttttgggggcggaggttattttagtttagtagataatattaaaggttgagtaatgttcgtttgttcgttggggttagggttggggttagtgggttggggattagtttcgggtaggttgggagtttttgtttaggtggtttgggttaggagtggtagagaggtgggtttagggagttgttttaatggtttaggaatgggttcgggagggtaaagggttttttaatttgagtttatttagtagaggcgggtaagtggttagaaggttttgggtttgtgtttaagtttaggcgggtcgttgtcgttttttcgtttgtgaaatggtagtagtaaaagtatttttttggtggggtgaaaaaagttgaatttcggggtgtaggtttatcgtaagtatagggtagggatttggtaaaaatttattttttttttttttttttttttttgtatattattttttttcgtgaggtttcgtttaagtttttttttagtaattttagaaatagaagtttttggtttttgggattggtaataggttttagggtttagatgagggtattttatttgggatgaatgggggatatgcggttatgtgattttggtatgttacgttatgttttttttgggtttttattggtataattcgtgggggtttcgttttttttgatgtgtagtttataacgtaagttttaggtttgggagtttggtgggaataatgttattattattgatagtagcgatattttttatggattgtagttgggagaagtgaagtgatttatttaaggttatatagtgtggtagggtcgagtatttttcgtttttgttttattttagggtttaggtcgggtggcgtagcgcggggtaagagaagattcgggcgtgtttaagtttcgagtaggcggtaggtgtggtgggcggggttaggggcggggtttcgtggattagggtttagttttaagcggggcgcgattttgttcggtcgcgtcgattttcggggtttttatattgtttgtggtttaagaggggagtcgttataggcgttaagttttttttttaaagtcggggatttggggaggaggtgggagtttacgggaggaagggttacggagatgggtcgttttttttggagttagagttgcgggttggggtttttagggttcggttcggggagtcgattttggtcggtcgtcggggttttgttcggtttttttgaaattttcgttttttttagtagggggcgggtcggggtcgcgtttcggggggaaggcgattaggtcgttttttttttcgattttttcgttttttaggatagtttttagtttagaggggcggttcgggggcggggtcgtatcgttttttttcgtttttaatttcggggcggtcgggcgggggtgggtagggggcgtgaggtcgtttttgcgtttcgggggtttttcgaaaacgcgtttcgggtgttcggttttttcgttgcgttttgtcgtcgttttttcgggggtttcgggcggtcgcggtcgtgtttttcgcgtttcggcggcgcggcgggaggggtcggcgtgacgtagcggttgttacgggtcgtttttataaataatcgggtttaggagaaattttagcgagttagagtcgcgtacgggattgggaaggggatttattcgagggtttagttattagtttttttattaatagcggttatttcggtagcggcggtagtagtagtagcgacgtagcggcgatagtttagagtagggaggtcgcgttatttgcgggtcggtcggagcgggtagttttaggtttttttttcgggtattcgcgtttatgtaacgtttggtggtttgggatttagtatgtttttttttgtcgtcgtcgtcgtttgtttttaaatttatggaagtggttaatttttattacgaggcggattgtttggttgttgcgtacggcggtaaggcggttttcgcggcgtttttcgcggttagattcgggtcgcgttttttcgtcggcgagttgggtagtatcggcgattacgagcgcgttatcgattttagttcgtatttggagtcgttgggcgcgtcgtaggtttcggcgttcgttacggttacggatattttcgaggcggtttcgttcgcgttcgttttcgcgttcgtttttttcgggtagtattacgatttttttttcgatttttttttcgacgattacgggggtaagaattgtaagaagtcggtcgagtacggttacgtgagtttggggcgtttgggggtcgttaagggcgcgttgtatttcggttgtttcgcgtttttgtatttatcgttttcgtcgtcgtcgtcgttcgtcgagtttaaggcggagtcgggtttcgagttcgcggattgtaagcggaaggaggaggtcggggcgtcgggcggcggcgtaggtatggcggcgggtttttcgtacgcgttgcgcgtttatttcggttattaggcggtgtcgagcggtagtagcgggagtttttttacgtttttttcgtttagttcgttcggtacgtcgagtttcgttgacgttaaggcgttttcgatcgtttgttacgcgggggtcgcgtcggcgttttcgtaggttaagagtaaggttaagaagatcgtggataagtatagcgacgagtataagattcggcgcgagcgtaataatatcgtcgtgcgtaagagtcgcgataaggttaagatgcgtaatttggagacgtagtataaggttttggagtttacggtcgagaacgagcggttgtagaagaaggtggagtagttgtcgcgcgagtttagtattttgcggaatttgtttaagtagttgttcgagtttttgttcgtttttttcggttattgttagcgcggttttcgcgcgcgtttttttgtcggtcggggttgagatttcggggagcgttcgcgttcgcgttttcgttttcgttttcggcggcgtcggtaaaattttggtattggggtatttggtagcgcggggagttcgtcggtaattttaatattttattatatatatatatttatatttttgtttaaattaatcgtatatgtagatggggttttcgttcgtggtgttatttaaagaagaaacgtttatgtgtatagatgaatgataaattttttgtttttttttttgtttttttttaggcgtcggcgggcgggtcggtttcgaagttgatgtaatcggtttaaatatggttgaacgcgtgtgtatacgggattgacgtaatttacgtgtaattgttagtcgggttttgagtaatcgtttaaagatgtttttacgggtttgttgttgttgatgttttgttttgttttgttttttggtttttttttgtattataaaaaataatttatttttatgagaaaagaggcgtttgtatattttgggaatttttttcgttttaagtattaagaatatttttaataaatttttttttgagaatggttataaagttttttgggggtagtaattggtttttgttttttatttttttattttattttggatttgtaggattttgtttttgcgtttttggtgtgtagggggttgtgtgtggggggttgttgttatttttggaggttttggtggttgggtgggggtgttgtagttggtttttttgttttttttgttatttttttttttatatatatagggtttgtttgagatggggttttagtttcgggggaaaggggagaagagtaatgggttaggtatttaggttgatttagagtttttaggcgtcgggacgggtggttgggaattttgtttgagaagagatttcggagtttttggttggtttcgagtgttaggtttgggtttggaagggttgggaggtttgtgatttttgttt

SEQ ID NO: 204 - DNA, 7038 bp, Artificial Sequence
  chemically treated genomic DNA (Homo sapiens)
gggtaggggttatagattttttagtttttttaaatttaagtttgatattcgggattagttagaggtttcggaatttttttttaagtagggtttttagttattcgtttcggcgtttaggggttttgagttagtttgaatgtttgatttattattttttttttttttttttcggggttggaattttattttaagtagattttgtgtgtgtgggagggggagtagtagaggaggtagaaaaattagttgtaatatttttatttaattattaaaatttttaaaaataatagtagttttttatatataattttttatatattagaaacgtaaaaataaaattttataaatttaaaataaagtaaaaaaataaaaaataaaagttaattattgtttttaaaaggttttgtaattatttttaaaaaaaagtttattaaaagtgtttttaatgtttgaaacggaaaagatttttaaaatatatagacgtttttttttttatagaaatagattattttttataatataaaaaaagattaaaaaataaaataaaataaaatattaatagtaataagttcgtaggaatatttttaagcgattatttagggttcggttgatagttatacgtgggttgcgttagtttcgtgtatatacgcgtttagttatgtttaaatcgattgtattaatttcgaaatcggttcgttcgtcggcgtttggagaggggtagagggagaagtagagagtttattatttatttgtatatatagacgttttttttttaaataatattacgggcgggagttttatttgtatgtgcggttggtttggataaaaatatagatatatatatataataaaatattaaaattatcgacgggtttttcgcgttgttaagtgttttagtgttaaagttttgtcggcgtcgtcgggggcgggggcgagggcgcgggcgcgggcgtttttcggagttttagtttcggtcggtagggggacgcgcgcgggggtcgcgttagtagtggtcggaggaggcgagtaggggttcgggtagttgtttgaataagtttcgtagggtgttgagttcgcgcgatagttgttttatttttttttgtagtcgttcgttttcggtcgtgagttttaggattttgtgttgcgtttttaggttgcgtattttggttttgtcgcggtttttgcgtacggcgatgttgttgcgttcgcgtcggattttgtattcgtcgttgtgtttgtttacggtttttttggttttgtttttgatttgcgagggcgtcggcgcggttttcgcgtagtaggcggtcgggggcgttttggcgttagcggggttcggcgtgtcgggcgggttggacgaggaggacgtggagaggttttcgttgttgtcgttcggtatcgtttggtagtcgaggtaagcgcgtagcgcgtacgggaagttcgtcgttatgtttgcgtcgtcgttcggcgtttcggtttttttttttcgtttgtagttcgcgggttcgaagttcggtttcgttttgagttcggcgggcggcggcggcggcgggggcggtgggtgtaggggcgcgaagtagtcggggtgtagcgcgtttttggcggtttttaggcgttttaggtttacgtagtcgtattcggtcggttttttgtagtttttgttttcgtagtcgtcggagaagaggtcggagaggaagtcgtggtgttgttcggaggaggcgggcgcgggggcgggcgcgggcggagtcgtttcgaaggtgttcgtggtcgtggcgggcgtcggggtttgcggcgcgtttagcggttttaggtacgggttgaagtcgatggcgcgttcgtggtcgtcgatgttgtttagttcgtcggcgggggggcgcggttcgggtttggtcgcggggggcgtcgcgggggtcgttttgtcgtcgtacgtagtagttaagtagttcgtttcgtagtagaagttggttatttttatggatttaaaggtaggcggcggcggcggtagggggagatatgttgggttttaggttattaggcgttgtatgaacgcgggtgttcggggagggggtttggggttgttcgtttcggtcggttcgtaggtggcgcggtttttttgttttgagttgtcgtcgttgcgtcgttgttgttgttgtcgtcgttgtcggggtggtcgttattagtgagggggttggtggttggattttcgggtgggttttttttttagtttcgtgcgcggttttgattcgttaaagttttttttgagttcggttatttataagggcggttcgtagtaatcgttgcgttacgtcggtttttttcgtcgcgtcgtcgggacgcgaaggatacggtcgcggtcgttcgagattttcgggaggacggcggtagggcgtagcggagggatcgggtattcggagcgcgttttcggggggttttcgggacgtaggggcggttttacgttttttgtttattttcgttcggtcgtttcgggattgggagcgagagggggcggtgcgatttcgttttcggatcgtttttttgggttggaggttgttttggaaggcgggggaatcggaggagggggcgatttgatcgtttttttttcgagacgcggtttcggttcgttttttgttggaggaggcggaggttttaggagggtcgagtagagtttcgacggtcgattagggtcggtttttcgggtcgaattttggagattttagttcgtagttttagttttaggagaagcgatttattttcgtggttttttttttcgtaaatttttattttttttttaggttttcggttttagaaagaagatttgacgtttgtgacgattttttttttaagttatagataatatgaggatttcgggggtcggcgcgatcgggtaggatcgcgtttcgtttggggttggattttggtttacggagtttcgtttttagtttcgtttattatatttgtcgtttgttcgaggtttggatacgttcgggtttttttttgtttcgcgttgcgttattcgatttgggttttgggatggggtaggggcggggggtgttcggttttgttatattgtgtgattttgggtgagttattttattttttttagttgtaatttatgaagggtgtcgttattgttagtggtggtggtattgtttttattagatttttaaatttaaggtttacgttgtgggttgtatattagagagaacgggatttttacggattgtgttagtggaggtttagagagagtatggcgtggtatattaaggttatatggtcgtatgttttttatttattttaaatgaaatgtttttatttgagttttaagatttattgttagttttagaggttaaaaatttttgtttttgaagttgttagggagggatttaagcgaggttttacgggagggggtggtatgtaggaaagagaaggaaagagaaagataagtttttattaagtttttgttttgtgtttacggtgggtttgtatttcgaggtttaattttttttattttattaggaagatgtttttgttgttgttattttatagacgggaaagcgataacggttcgtttggatttgaatataggtttaaggttttttgattatttgttcgtttttgttgggtaggtttaggttagagggttttttgttttttcggatttatttttaggttattggggtagttttttgggtttatttttttgttatttttagtttaggttatttaggtaggagtttttagtttgttcggggttgatttttagtttattgattttagttttggttttagcgggtaggcgggtattgtttaatttttggtgttatttgttgagttggggtgattttcgtttttaagagttggagaaatgatatttttgggtatttttggtgggtaggaggtagggagggaggggataaaatattggtttagtttgttggttttttgggtttttttagtagtttttgggttggggagggattaaggtttagaggggtgcggtagtttttttagggttattcggttagtttttttttattgtaaaatgggatatttagggttgagttagaggttacggtttttgagaggttttttttgttttatttgttagtgaatttttttttttatcgttagttattattattttagttgtttattttagtttttttgtaggttgttatttggggagggttggtttacgagggatttttgagtatagtacgtttaatatttattagtgaaggaatgtatttgttgttttttgtgtattaagaatattgttattttatttttgtttaaggtagttttttaggttttagtttaaaagttgtttttttcgggaaattttttttgatttttttatgggaagtttaggtttttagttattttttttatatttttgttttattttcgttattatttttattataattagaattattttgtttgttagttttgttgtttgtttttacggtttttattattgtgtttttggtgtttagaatagagtttggtatatagaaggtgttcgatgaatggtgagtgaataaatggaggaggttgagaagaaggagaggtttttcgttagttgggttgtgtgattttaggtaaaatggtttttttttttgaattaaagtattcgtttacgttttttttttggattttgaagagatgtagggagatatgggggaattgaagttaattggaggatttgttgtgtgtttttaggttaaatttttattttttttgaattatattttaagttttttgtatgtattaatttatttaattttattgataatttgtaggaggtaggttttttttttttttttttttttatattttttaatgttttgtagagatggatatgttttattttgttgtttaggtttttttcgaacgtttggttttaagtggtttttttgttttagttttttaaagtgttgagattataggtgtgagtcgttgcgttaggttatagttttattattatttttattttatagatgaggaaattgaggtttagaagagttaagtgtgtttgttttaggttatatgaaaggatgagaaggaataaaatttttttagtttgatttttttttttgggtttgttataataggtttggtaatgtgagttttattttttggatagaagaattgaggtatagagaagggtagatttggggttatatagtgcgttaaggtgttattcggattttgtaggttagtttttaaagattagatttagttttagtaggggtttaggttttttggtttttggggtggaatatgtttgttatttttttttattttttattttttgttggggatgatttatttttttttagcgtaggttttatttcggtgtcgatttaggtgttttgtagggaagttgtaagttaggatgacgtaagtttttgtttttataaggtttttgtttaataggtttcgtttgttgtttttttatttttattttagtattgtttagtttttttttaagaagtggggatggtgggagtttgaattattacggtttagaggtttagagtacgtgagtggttgtgtgggtataggaaattaggatttttttggcgttattttttttagttatttgtttttagaatttagagtcggaaaggattttaaattggtagttagtggttaaatcgagattatagatgtgtttaatttgattttatagcgttttgtttgatgtgtgtgtgtttaagtgaatttattgttaatatttaaaaattaggagattttatattaaaatttaaatttttagttttttttttaaaatttgaagttgtgggttgggtttacgtggttatatggtggtgggtaggagttaggcgggggcggggagggaataggtatttttttatttgggatatacgtttttttttgtttttaaattgttttttataattttttttttttatttttgtagtttttttttattttatttttaagaggagaaaattgaggcgatttgttaaggggagatttacgtggttgttttgatagagagtgttttgtaaaagggtttagaaattagttagtaggtgggaaaatatggcggagaggtgaattattagaatatgaatgggggggtgtttttagtgggcgtggggtagggggatggtagggggatggttttttatgttgttttgtgttttttatgttgtggtttttcggtcgtgtttggtgttttttttgggttttagtttttggtatataaaatgaggtgataatattttatttgggattttgggtttgttgttattttttattgttggtttttttcgatatattagagttaattagatgttttttttattttataaagtaggtagatggggaaattgaggttcgaagaggattagaattttttatttttttttttaaattttttttgtatttttgtgaatgggtataagagttagatttaaaagttagattttttgattttaatgtttgagattttttttattatgttttttttttgaggttttagtttttttatttgttaagtggggttggtagagatagatttttaagggttgttaggtttcgaggttttgagatttaggattttggagacgggaggtgtttaggatcggtagtgaaatttgtttgagtatatattgtttttaggtggtaggttttgggattgtaggagttatttatatgcgtgaagattcgttgggcgtttttgttttgggattaggaaaggtcggtgttatggatgtgatagatgtatatagggtattagtaggtcgtcgagaggaattagagtgtttaacgaatagaaaatagtgtttaatttttatatttatcgaatgttttttggtatatgttgtaattttggttttaaagatatatttatggataagataagtaatttttgttttcgtggagttgaaatttttttgggggaagataagtattaaataagattaatgattaaagtatagattgtattagattttggttagtattatggaggaaaatatagtaggggagtagagtaggagttttggg

SEQ ID NO: 205 - DNA, 17142 bp, Artificial Sequence
  chemically treated genomic DNA (Homo sapiens)
aaatatatttttaggttaggcgtggtgttttatatttgtaattttagtattttgggaggcggaggtaggtggattatttgagtttaggagtttaagattagtttgattaatatggtgaaattttatttttattaaaagtataaaagttagttgggtgtggtggtatatgtttgtaattttagttatttgggaggttgaggtaggagaatcgtttgaatttgggaggcggagattgtagtgagttattgtaattttagtattttgggaggttaaggtgggtggaatatttgagtttagaggtttgagattaatttgggtaatatagagagatttaatttttataaaaaaaaatttaaatatatatatttaaaaatttttaattaaaaaaatataaaataaggaaatagaggatataatatattatttataatttatattttaattaataaaggagattttttattttgtatgagtagatttgtttttttgagatggagtttcgttttgttgtttagttggagtgtaatggtgtaattttagtttattgtaatttttgttttttgggtttaagtaatttttttgttttagttttttaaatagttgggattataggtatatagtattacgttcggttaatttttatatttttagtagagatggggttttattatgttgattaggttagttttaaacgtgtagatttttataatatataaatatatatttaaatagaaataagttaggtgtagtggtttacgtttgtaattttagtattttgggaggttaaggtgggtagattatttgaggttaggttaagattagtttggttaatatggtgaaattatttttattaaaaatataaaaattagttgagtgtggtagtgggcgtttgtagttttagttatttgggaggttgaggtaggagaattgtttgaatttgggaggcggaggttgtagtaagttaaaatcgcgttattgtattgtatagtttgggtaatagagtgagattttattttaaaaaaaaaaaaaaaaattaaagtgtttttattttaaaaaagataagaaataataattagatattttttaatgtttagttgttaatatttttttgtattttagttgggttttaaaagcgagattgagatataagatttgtttttttttagtataattagatgtgtttacgtttttttggatttaaataaaatgtaaagttattttttttaaggagtatattatagataatgtgtttttttagaatgtttttttttatattagatagattggggttttttttgtttttgcgcggggggatagaattttgttttgtcgtttaggttggagtgtagtggtgcgattttagtttattgtaatttttattttttaggtttaagtgatttttttgttttagttttttaagtagttgggattataggtatttattattatattcggttaatttttgtatttttagtagagatggggttttataatgttggttagattggtttcgaatttttgatttcgggtgatttattttgtttttttaaagtgttgggattataggcgtgagttattatgtttaatttagatagattgttttataagggtttagaaagaaaggaaattatatgaatgagtatttagttttttgttttttgaagtggatgaattgttttttttggtttttaatatagtttgttaagagttgtagtacgttttaagagtatgtgtatgtagtggagttgggatggggaggatttttaagggaatttttagttgttatttatgaattatgtagagtggagaaggatatttagtttttttgtggtttttatttgtatgattattttggtggttgtaaagggcgataggtagtaggaggagatatttcgtgatattaagagttgtgtttagatatgatcgttttggtatagtttgagggttttttatagaaattggtagagatgttagatagatataagatgttagttagttttttttgcgattggtttttagaggtggaaaatggtaaagttattaggtttattttttttaggattagaggaatatgttaattatattaaagtagattagtgggtcgggtgtggtggtttacgtttgtaattttagtattttgggaggtcgaggcgggcggattatgaggttaggagattaagattattttggttaatacggtgaaattttgtttttattaagaatataaaaaattagttgggtatggtggcgggcgtttgtagttttagttgttcgggaggttgaggtaggaaaatggcgtgaatttaggaggtggagtttgtagtgagtcgagatcgtattattgtattttagtttgggtaatagtgtgagatttcgttttaaaaaaaaaaaaaaatgtagattagaacgattaaaatgattattggtgattattggtattattgttgtaatagtaaaaatatattttttttattaatgtttttgtttttttttaaaatgttttatcgttttttgattattatggtttatttttatttttattttatttatttatttatttttttaagatatagtttcgttgttatttaggttggagtgtagtggttcgatttcggtttattgtagtttttgttttttaggtttaagcgatttttttgttttagttttttgagtagttgggattataggcgtatgttattatatttggttaatttttgtatttttgtagagatagggttttattatgttggttaggatggtttcgattttttgattttatgattcgtttgttttagttttttaaagtgttgggattataggtatgagttatcgtgttcggttttattaatgttttttatttatgtatttttttttatggattttatttatttatatatggtattttatttaatatgtaataaatatttattaagtagttattgtgtgtttagtgttgggggtatagttgtgaatattattaatatggggttagatgtggtggtttatatttgtaatttcggggttttttttttttttgagatggagtttcgtttttgttgtttaggttggagtgtaatggtaagattttagtttatcgtaatttttgtttttcgggtttaaacgatttttttgttttagttttttaagtagttgggattgtagacgtgcgttattatattcggttaattttgtatttttagtagagacggggtttttttatgttggttaggttttaaatttttaattttaggtgatttgtttgtttcggttttttaaattattgggattatcggcgtgagttattatgtttagttttattttagtgttttaggaggcggaggtgggaggattatttgaggttaggagtttgtttgggtaatatagtgagagtttatttttataaaaaaatttaaaattagttaggtgtggtggtaggtgtttgtagttttagttatttaggaggttgaggtgggaggattgttttagtttaggaggtcgaggttgtaatgagttatgattgtgttattgtattgtagtttgggtgatagagtaagattttgttttttaaaagaaaaaaaaaaaaaaaaaaaaagttttggttaggcgtggtggtttatgtttgtaattttagtattttgggaggttaaggttggcggattataaggttaggagtttaagattagtttggttaatatggtgaaatttcgtgtttattaaaaatataaaaattagcggggtatggtggcgggtatttgtagttttagtaatttggggggttgagttaggaaaattgtttgaatttgggaggtagaggttgtagtgagttgtgatagtattattgtattttagttttttagtttgggcgatagagtaagattttgtttttaaaaaaaaaaaaaaaaaagaaaagtttttgttgtatagaattttttaggttatggatggggaggagggtaggggtttaggaggggagaagcggaaggaggaataaaataaagaagagataattagttggagagtgataaatattataatgatattatggaattaggtttattagattaaatattgggtatttagtttaatgtgaattttagataagtaatgtatgatttttaagtataaatatgttttatatagtatttatattagaaaattataaatttttttttaaaatttatattgatttgggtagtttgtattttatttgttaaatttggtaattttaatttgtgtgttgggtggtggtgagtgggtaattttagataggttttttttgtggaggtgatatttgagttggaatttaaatgtaaagaaggagttaattatttaggaatttagaatattttagtatagggaatagtaagtataaatgttttaaagtggaaataagtttggagtttagaggaataggaagaaggtggggtggcggagttgagtgagggtgaggagaggagggaagcggaaggtgatgagggtaggtaggttggtaggggttagattttatatggtttgtgggttgtaataagagtattaaaatttatatattaggttaggcgcggtggtttacgtttggaattttagtattttgggaggttaaggtgtgcggattatttgaggttaggagttcgagatttgtttggtcgtgtttttttttaaaatagaagttttaagaggggtaggaagttttttttcgttttagattttatgtgtacgattttggatcgattaatattgaatattttttacgtgttaagttttgatattaaaatgggttagaagttagtagtcgttcgttgaatttgtgtttttttttggaaaacgagaatcgtgaagtttgttggtatggttagagttaaagagtattgttatttgtgagattagcgtagaaatagagcggggtttcgattggtttttcgaatttgggtggggttagagtatttttggtttcgttttttgtagcgggtcgttcgtttatgcgttttggttttaggttcgttgtcgcgttattttgtcggggtttgaatgtgaggcggagcggcggtaggagcgggtagtgttagttacggttcgcggttggggttttttttttcgtttttgtatttttacgaggtgaggcgcggggcgtgtacggtttattagagtggtttttggggtttagttgaggaagggatgaggcgttttcggtattaacgagcgttagggagtgagaatcgcgtttttgggcgagagcggaatgtgggttcggggttcgggtggtgcgtttaggtaaggttttcggtttttttagggagcgtttgtcgcgtttcgcggtattttaggtttttggtttaggtgcggcgattttagggtttgtgagggttgagggtaattgaggcgcggtttaacgcgagtttgcggattgttcgtttttttttttttattacggcgttgattggttgcgtcgtcgttttttcgttcgggaaggtcgttttttattggtcgcgttcgtatgtttattttttgcgacggtggttgttagtcgcgcgagttgagtgtgcggcggcgaggtttgttcgggcggggattgcgggcgcgtggagttgcggttgtttcgcgtcgttttttgttttaattttagtgaagttttcgaatttatttttttttaatttttgtatttgtatttttgattgtaaaacgggtatcgtgattttattttgttgaattgtttgtgagaattttagtcggtatattcgggatatagaaattttttgtaacgcgggttgggggagggttttttcgttttgggagaaacgttgtgttgtggtggttcggagtatagattttggaattagatcgtttgggtttattttagacgtagtttttcgttaggggtgtaatttgaggttggttattttattttattgagtttttatttttttagttgtaaaatggggttaataatagaatttatttcggaaagtggttttgaggatgcgttgagttatttatcgtggtttataaaggttttttgggagttgacggttgtttatttattttttttatttatttttttttttagttagtgtggttttttgttttttttatattttagggttatttcgatttaaaattatttgtatatgttttttgtttgttggggaagtattaatatttttgtaaggtaggtcgttttttttaagttttttttattttaggttttttttaattaatttttttttttgtttttttttttttttttttttttttttttttttttttttttttttttttttttttttgagagagagagtttcgttttgttttttaggttggagtgtagtggcgcgatttcgatttattgtaattttcgtttttcggatttaagcgatttttttgttttagtttttcgaatagttgagattataggtttgagattatacgttattatattcggttaatttttgtatttttattagagacggggttttattatgttgattaggttgtttaattaatttgtttaggattttttttttatggttttttattaatattatttggttttagttattttatagtatttattaatatttatttattgtttatttgttattttttttaattgttagaatgtaagttgtttgagagtaaggattttgtttgttttgtttatttttttttttttggtgggtgttattttatttgtgtttgttatatggtagatgtataagtattatttttttttggaggtatagaaggggattttttagttttggattttattaattgtttttttttttattttgggtttatatagttatatttttggtttttttttgtgtgtgttttttttttttttttttttttttttgatatgtttttagaggattttaatggatttcgttttttcgtttttataattttttattttttattttttattattagtgtaagggaagtttttttttttttttgattatttttgttggttggggtttgggataggattggatggatgtaagagtagtgttttagttttggaattaatttgtttttttatttatttaataattttattgagtatttatttaatttttgggaatatagtgaaaaaataaaaatggataaggtttttttttttgaggattatgtattttcgtgggcgaaagaaaaaatattagataattttagatagtgatagaattatgtgataggtgaagaaggtttttttgaggaggtgatatttgggtagagattagttattaaaaggtgaggggtagaatattttaggtagagggaatagaaggtttaaggtttaaggataggaatcggtttggaatattgaaatatttaaggaatattttaggtttttagagtgttatatgaagaagggagaaatatttaggattcggattatagaaggttttgtaggtaatgtaaggagtttggatttgattttaagtggtatatttttatggttagaaagtagagggtaggttgaggtgttgggatatgttttttatgtgtgggtgttagatagtttttatttattggatttttttttttttttttaaatgtaaggtttcgggaatggttttttaatgtgttgaggatatatttaagaaaaaggtagatattttggattagtttatgttatagatgtttgtgagatggttttggaaaataaagtttttattttagaaatttttatttgtaattgagggtttgtgggaagatgttagatttaggtttggttatttatttaataagaagaatttggaaatttagatgtttgttataattgatttattgtgatgtttttttaagttttttaattgtgtattggtagagatttttaaagatagttacgtggagaaagaaaagtattatttttttatttaaaggtgataaaaatgaatttttatttttttttttttttttttttttggagatattattttattgtgttgtttgggttgatttgggtttagtttatttttttattttagtttttcgagtagttaggattataggcgtgtattattatatttaattaatttttattttttttttgtagagatggtattatgttgtttaggttggttttaaatttttggatttaattaatttgtttattttggttttttaaagagttgggattataggtatgagttattttatttggttaaaatgaatgttttgtttttagtttgagttatttttagattagtaatattttttgtatttatatattgttaatattttagagtgttaaagtatttttatttgtggttgtataagataattagagtttgattttgttgataattatgaatatttgtaaaatgttttttaaaagtttttgattttttttatttttttaaattaaggataagtttagaattcggttttatagattatatttgtaaggcgatataaaaaggatttgttgataaatagttttttaaagaatatttttaaagaataaattttggaaggttaaggtgggcggattatttgagtttaggagttttagattagtttgggtaatattggaattatgtttatagaaataatataaaaattagttaggtgtggtggtgtgtgtttgtagttttagttatttgggaggttgaagtaggaggatggtttgagtttaggaggtagaggttttagtgggttagaattatattattgtatttttttagtttaggtaatagatttagattttgttttaaaaaagagtattaagattttgggatttatgtagtattttaattttgagggattataatatgtatatttatataattttttatttttttttaaatttaaaaatagttttattttagtattttaatttaattattttaggttttattttattatgtggttttatttatttatttttattttattttattttattttattttatttttggagatagggttttatttagttatttatattggattgtagtggtaagattttagtttattgtagtttagatttttcgggtttaagtaatttttttgttttaatttttttagtagttaggattataggagggtattattaagtttagttaatttttttttttttttttttttttttttgagatgggagttttatttttgttgtttaggttagagttagagtgtaatggtgtagttttggtttattgaaatttttgtttttcgggtttaagtaatttttttgttttagttttttgagtagttgggattataggcgtatgttattacgttcggttaatttttttttttttgtatttttagtagagacggggttttattatattggttaggttggtttcgaatttttgattttagatgattcgtttgtttcggttttttaaagtgttgggattatagacgtaagttatcgcgttcggtttgagtttagttaatttttaaaattttttgtagagataggattttattattgttgttaagtttggttttgaacggtttttggggttaagtgatcgttttatttttattttttaaagtgttgggattatagaagtgagttattttgtttagtttgttgtggttttagaatttagaaggttgtgtttatttttttttgtttgatatagttaattaattaaaataaagatgaagaataatatttttgatggaaatattaaaggtatttagttttttaaaatagtataataaatatataacgggtgtttattattattgtaaggttttagggagagagtagtgaataaagtataaagtttttattattagtggagtttataatttagtgaagagagaagtatagtaaatgataaaagaaattaatatgtttgataaaatgtatttggaaaatagtagagtaagggtatggagagtaattgaggtgaatgtttttttagataggatggtgtagtaaggtatttttgaaaaaaagatgatatttgaaaagagtttttttaggtcgggtacggtggtttatgtttgtaattttagtattttgggaggttgaggcggtagattatttgaggttaagagtttgagattagtttggttaatacggtgaaatcgtatttttattgtatataaaatttagtcgggcgtggtggtacgtatttgtagttttagttatttgggaggttgaggtaggagaattgtttgaatttgggaggcggggattgcggtgagttgagattacgttattgtattttagtttgggtgatagagtaaagatttttgtttttaaaaaaaataagagttttgaatgagaatgaagtgggtagtgtaaattttgtagtttttcgtgtgtagagttttgtaggtagaaggaatggtaagtatagaattttgaaataaaagtaaaattattggtatgtttgaataggtaatataggataaattttatttttttttagagatagagttttattttgttgtttagattggaatgtaatggtatgattatagtttattgtagttttaaaattttgagtttaattagtttttttgttttagtttttagagtagttgagattataagtgttcgttattatgtttggttaatttttatttattgtagagatagggttttattatgttgtttacgttggttttgaaattttagttttaagtgattttttcgtttcggttttttaaagcgttgggattataggtatgagttattttgttaggttagaataaatttaaaaatttatttttttgaagtatttttgaataaataaatttaattgtggtagttaagttggttatttgtttatttgatatttatgtaattgagtttttatattatgttggggttgttaatgattgatttgaagggatagtttttagttttgattggaaatttatgttttgttgggtgattgatatgttgtgatttattttttagtttatataataaatgtttattaaatatgtattgtgtgttaggtaatgttgaaggttttgagtatatagacgaaagtttttgtttttaggagtttgtagtttagtgtgtgtatgagacgataaagaagtttattttaaatgagggtaattgttaatatagtaaaataaggatgatgtagatggtaatcgtagaaggtttttttgaagagttgatagtgggttgagtgttgaatggtgtttattattaaattagaggatgagtattattatggttagggagaatttttgtggttagtttgtagaatagaaggtttttgtgtttggaatgtagtaagagttaggaggaggtaggagatgaggttagtagatattagattgtttagattttgttgtggtaagggatttggtggtggtggtggtggtggtggttgttttggagatagggttttatttttattgtttagtttgtagtgtagtggtttgattataatttatagtagttttaatttgttggatttataggtgtgtgttattatatttggttaattttttgtatatttagtagagatagggttttgttgtgttagtttaggttggtttgaagtcggttgaagtaatttatttgttttggttttttaaaatgttgggttaataggcggtagttattgtatttggttaggagtttgggtgtttaagataagtaattatgaggaatttaaggagttttagttgagaaatatataaatgttagagaaatataatgaagaaagtgaaatgtagatttattaagaagtgtatttttaaaaattaagaaaataagttttgtgtggtggtatatgtttgtagttttagttattttagaggttgaggtaggaggattgtttgagtttaggagttagaatttaatttggataatatagtgagattttttgttttttttttttttttttttttttttttttaaagataaaatagatttgtaaatttgtttttgtattttttttatttaagtttttaataatttgttttgtatgaatttttaaaggtagaataaatttgtatatggtaaagaaaggttaattttttttaatttagatatattgatgttaatgatttaatttgattatagtaaattaatttttttttttttttttttttttttttttgagattgcgttttttttttgttgtttaggttggagtgtaatggcgtaatttcgttttattgtaatttttgttttttaggtttaagtaatttttttgttttagttttttaagtagttgggattataggtatgtgttattaggtatggttaatttttagtagagacggggttttattatgttggttaggttggttttaaatttttgattttaggtgatttgttttttttagttttttagagtgttgggattataggtgtgagttattatatttggtttaaatttttatgattttataattgatttattattttaatatagaaaaaaggaataggaaaataaatggattaaattattgttttttaaagtgtgttttattgaaaaggagttttatagttaaataatgggagagattgggtaatttttttattttagttttttaagtagttaggattatagggttatattattacgttcggttaattttttgtatttttagtagagatggggttttgttatgttgtttaggtaggttttgaatttttgggtttaagcgatcgtttgttttagttttttattagtggagattttggattaattgatgtgaattagtaattttgtgagtttaaagtgttttgtattgtgaatttttaaagtggggtaggatataatgtgtagtattttttaaatttgtgatataaaaaattataaagggtatagttttttaatagattgtatgtgtggtttaatgggatttgatttttatatttatagagtggaatatttggattagagggagtgattaggtaggtggtgggatttatttagttagaatattagttttttgtgataaatatattttttaattaaggggaaggattgtagtatgtagaatatagataattttttttagaaggttggggtttttggttgttggggagtgttttgtataagtatagtattagataatatttttttattttttggttttttatcgtttagttgttttttggttgttttttttttatattagtttttttattgtgttgtgagtgtttttatttttggttagtcgtttgttatttttatttaagaggtagttttgggtaatagaaagagggtagatttacggagttggattgatttaaatttgatttttatttattaattatatatagttaatatatgttaatttgagtgtttttttttgtgtgtaaaattattgtgtggaataaatgatatgaagtttatgaaaatatttagtatcgtgtgtttggtttatatatgtgatattttttttattttgtaaattattattagtttaaaggttttttattttatttttattatatttttatttatttaagaaaatttttatgatttttttatatattaaattatggtattttttagttaagtatggaggaatttatatgatttggttttgattttttagtttattattttttttttttatttttgttattttgtttttataatttattttggtagatgcgtttttattttattttgtttatttagatatatatattttttaaggtttagtttaaggtttaggttttgggaaatttttggatggttatataatttcgtgattttttttttaattttttaacgtttaaggtgttgtttttgtgatttatttggtattttagaggatagatgttttagaatttgggattttttttggatgtatgtattgtggattatataatatttttagtggggtttggggtagtattttgtaattaaacgtattgatatttttttagtgaaataaatttgtatattaagtgagataaatttatgttgatagttttaggtagtttaggttggttttgttgttaagtgagtttgttataaatttgttaaaaaataaatttttaagtttttttatttttggattttattattttagtaaagggtatataggtttgtatttggtattttagttgtgttttgttttttgaattattatagaagttttttttaggataggaatttgattgtatattgttataggtattttaaaaataaatgggtttcggtatggtgggttatgtttgtaattttagtgttttgggatgtcgaggtaggaaaattgtttgaggttaggagtttaagattagtttgcgtaatatggtgaaattttatttttataaaaaatataaaaattagttaggtatggttgattgcgtttgtagttttagttatttaagaggttgaggtgggaggttggggtttgagttttggaggttgaggttgtggtgagttatgattatgtttttgtagtttaatttgggttatagagtaagattttgtttgaaaaaataataaaattttttaaattttttattgtaaatgtataatagatatgtgattgtaagattagaaaagtatgaagagaataaaattttttttatatttattatcgagatgttattattgttttatattttggagtgtgttttttgtttttttttatatgtgaagtttttttttataatttgaattatgatatttttgaattttttttattgattttttttatattttataaaaattgtgtgtttagtttttttttttttttttatagaagtttttggttaatttggtgtatgatttttttgaaagggttttatttttttatttatatgtggttatatatttaaaagttgtttaatggaatttaagtataagtggagttttttaaaatcgttttttttttttttggagataaagtttcgttttttttgaggttggagtgtagtggtataattttggtttattgtagtttttgtttttaggtttaagcgatttttttgttttagttatttaagtaattgggattataggtgtatgttattatgttcggttgattttgtatttttagtagagacgggatttattatgttggttaggttggttttaaatttttgattttaggtgatttattttttttagttttttaaagtgttgggattataggcgtgagtaatcgcgtttagtttaaaatagttttattgaagtataatttatatattataagatttatttattttaagtgaattgtttgggaaatgttagtaaatttatgtagattatgtatgtgttattatagtttaattttagaatattttgttatttttaaaaagtttttttagtttgtatttaattttatcgttttattaataagttggagattataaagtttaattgataagatttttaggatttgtgatttgttggtaattatgtatatttgatatttgtattttgtgtatgtgttgtttttgtgtgtttttttattttttttttaattgagtgggtttagattttttttttttttatttttaatggataaaattgtatatatttgtggtatgtatgttttgaaatatgtatatattgtataatggttaaattaagttaattaatatattattttatatgttgtgtgtgtgtgtgtgtgtgtgtgtgtgtgtgtgtgtgtggtgaaagtatttaaaatatatttagtaatttttaagtgtataatatattattatagttattttgttgtataataaattttttgaattgtgtattttttagtttatgttgttagtagttaaatcgacgtaggttatttagttagtttaaaatttgtgggttgggtacggtggtttacgtttgtaattttagtatattgggaggttaaggtaggaggattatttgagtttaggagtttgagattagtttgggtaatattgtgagattttgtttttataaaattttttttttaatttgttatttgttagatgtgaagttttttggttagttataagtatattatgtgatttagttttgtttaagttttaaatatgaaaatttttagaattataattttagttgttattttttgaattttagaatttatttttttagatgtaaatttttagtattttgtagtatttgcgattatatgttgtatatgaaggaattttttgtttttttaattttagaattttatgtgggatatttatttgttgtttaaaattttaatttttcgttgtggggttttttttttttttttttttaagataggttttgttttattatttaagttggagtgtagtggtattattttagtttattgtaatttttgtttttaggtttaagatatttttttattttagtttttcgagtagttgggattgaaggtatttattattatgtttggttaattttttgggttggttggttggtttgttttgagacggagttttgtttttatcgtttaggttgtagtgttatggtgcgattttagtttattgaaatttttgtttttcgggtttaagcgatttttttgttttagttttttaagtagttgagattataggtttttgttattatgtttagttaatttttgtatttttagtagagacgggattttattatgttgattaggttggttttaaatttttgattttaggtgattcgtttgttttagttttttaaagtgttgggattataggtatgagttattatgttcggttttaatttttttgtagttttggtagagatggggttttattttgttgataggttggttttttaatttttgagtttaagtagtttatttattttagttttttaaagtgtcgggatttataggtttgagttattgttcgggttttttatggggtttttttaataagtttttttagtgatttttttttttttaatttttattagtttttttttatagtattaaattatataaattttttggtgatttcgagtagttttttagtttttttttttatgattatttttttgaaattttgggatttttttttattttttttattataaaattgttttattattgtttttgggggaaaaggtatattttatttgttggatttttgttttagagttaggtttattgtttatataaaaaataatagatggatgatttttagagagaataatttataatataaacggatttttttaaatgtaaattatttttttcgtaagtgattagttatttaaattttattttatattttaga

SEQ ID NO: 206 - DNA, 17142 bp, Artificial Sequence
  chemically treated genomic DNA (Homo sapiens)
tttaaaatataaaataaggtttggataattggttatttacggaaaaagtgatttatatttaaagaaattcgtttatattatgggttattttttttgaaagttatttatttgttgttttttatatgggtagtaaatttgattttgagataagagtttagtaaatgagatgtgtttttttttttaaaaataatagtgagataattttgtgataagggagatgaaaaaaaattttaaaattttaaaaagatagttatagaaaaaaaagttgaaggattgttcgaagttattaagaagtttatatgatttaatgttatgggaaagggttaataaaggttaagaaaaaaaaaattattggaggaatttattaaagaagttttataaggagttcgggtagtggtttaggtttgtaaatttcgatattttgggaggttgaggtgggtggattgtttgagtttaggagttaagagattagtttgttaatagggtgagattttatttttattaaaattataaaaaaattgaagtcgggtatggtggtttatgtttgtaattttagtattttgggaggttgaggtaggcggattatttgaggttaagaatttgagattagtttggttaatatggtaaaatttcgtttttattaaaaatataaaaattagttggatatggtggtaggagtttgtaattttagttatttgggaggttgaggtaggagaatcgtttgaattcgggaggtaaaggttttagtgagttgagatcgtattatagtattgtagtttgggcgataagagtaaaatttcgttttaaaataaattaattaattaatttaaaaaattagttaggtatggtagtgggtgtttttagttttagttattcggaaggttgaggtgggaagatgttttgagtttgggggtagaggttgtagtgagttgagatggtgttattgtattttaatttgggtgatggagtaagatttgttttaaaaaaaaaaaaaaaaaaggttttataacgagaaattaaaattttaaatagtaaataaatattttatataaagttttgagattaaagaaataagaaatttttttatgtataatatgtaatcgtaaatattataaagtgttaagaatttgtatttagggagataaattttagagtttagaagatgatagttaagattatgattttagaagtttttatatttaaagtttaaataaaattaaattatataatatgtttataattgattaaaaaattttatatttaatagatgataaattaaaaaaaaaattttgtagagatagggttttataatgttgtttaagttggttttaaatttttggatttaagtgatttttttgttttggttttttagtgtgttaggattataggcgtgagttatcgtgtttagtttataaattttaagttaattaaatggtttacgtcgatttaattattaataatataggttaagaaatatatagtttaagagatttattgtataataaggtgattataataatgtattgtatatttgaaaattattgggtatattttaagtgtttttattatatatatatatatatatatatatatatatatatatatagtatgtgaagtaatatgttaattagtttgatttagttattatataatgtatatatattttaaaatatgtatattataaatatatataattttgtttattaaaaatgggaaaaaaaggagtttgaatttatttaattaaaaggaaaatgaaaaaatatatagaaatagtatatatatagagtataagtgttagatgtgtatgattattaatagattataaattttgggaattttattaattgagttttatggtttttaatttgttggtgagacgataaaattaggtgtaaattgagggaattttttgggggtgatagagtgttttaaaattggattgtggtgatatatgtataatttatataaatttattaatattttttaaatagtttatttaaaatggataaattttatagtatgtaaattgtattttaataaagttattttaggttgggcgcggttgtttacgtttgtaattttagtattttgggaggttgaggggggtggattatttgaggttaggagtttgagattagtttggttagtatggtgaatttcgtttttattaaaaatataaaattagtcgggtatggtggtatgtatttgtaattttagttatttgggtggttgaggtaggagaatcgtttgaatttggaggtagaagttgtagtgaattaagattgtgttattgtattttagttttagaaagagcgagattttgtttttaaaaaaaaaaaaagcgattttagaaaattttatttatgtttagattttattaggtagtttttagatatatagttatatgtagatgggaaagtggagtttttttagggaaattatgtattaaattaattagaggtttttatgaaaaagaagaaaaaaattaaatatataatttttgtaaaatgtaaaaaaggttagtggaaaaagtttaaggatattataatttaaattatgaaaaaaaattttatatatagaagaaaataaaaaatatattttaaaatgtagaatagtgataatatttcggtgatagatataaggagagttttattttttttatatttttttaattttataattatatatttattatatatttatagtaaggaatttaaaaaattttattatttttttagatagagttttgttttgtggtttaggttggattgtaggggtatgattatagtttattatagttttaatttttagggtttaagttttaattttttattttagttttttgagtagttgggattataggcgtaattaattatgtttggttaatttttgtattttttgtagagatggggttttattatattgcgtaggttggttttgaatttttgattttaagtaatttttttgtttcggtattttaaaatattgggattataggtatgatttattatatcgggatttatttatttttaaaatgtttatgataatatgtaattaagtttttgttttagaaggagtttttgtaatagtttagaagataagatataattgaaatgttaagtataggtttatatattttttattaaagtgatgaaatttaaaaataaaaaaatttaaaagtttgttttttaataagtttgtggtaaatttatttggtagtaaaattagtttgaattgtttgaggttattaatatagatttattttatttagtatgtaaatttgttttattaaagaaatattaatacgtttgattatagggtgttattttaagttttattggggatgttgtataatttatagtatatgtatttaaaaaaaattttaaattttgaaatatttgttttttgaagtgttaaatgaattataaagatagtattttaaacgttagaaaattaagaagggagttacggggttatgtggttatttaagagttttttagagtttgagttttgagttgaattttgaaaaatatgtgtatttgaataggtaaagtaggatgagggcgtatttgttaaaatgaattgtgagagtaaagtaatagagatgggaagagagaatagtgggttaggagattaagattagattatataggtttttttatatttggttgaagagtgttatgatttaatgtatggggaagttatgaaggtttttttaagtgggtaaaaatgtaatgaaagtggagtagaggatttttgggttggtaatggtttgtagaatgggggaagtgttatatgtatgaattaggtatacgatgttagatgtttttataggttttatattatttattttatataatgattttatatataaagaagggtatttaggttgatatatattaattatatatggttaataaataaagattagatttaaattagtttaatttcgtaggtttattttttttttattatttaaggttgttttttaggtggaaatgatagacggttgattaagagtgaaagtatttataatataatagaaaggttgatgtgaaaagagggtagttagaggataattgagcggtggggagttagaaaataagaaaatattatttaatgttgtgtttatgtagggtattttttaatagttagaaattttaattttttaaagagaattatttgtattttatatgttgtagtttttttttttaattagaaaatgtgtttattataggaagttaatgttttgattgagtagattttattatttatttaattattttttttaatttaggtgttttattttataggtgtgaaaattaagttttattaaattatatatataatttattgagaggttatattttttatggttttttatattataagtttggaaaatgttatatattatattttgttttattttggagatttataatataaagtattttaaatttataaagttattggtttatattaattaatttagagtttttattggtgggaggttgaggtagacgatcgtttgagtttaggagtttaagatttgtttgggtaatatggtaaaattttatttttattaaaaatataaaaaattagtcgggcgtggtggtgtggttttgtagttttagttatttgggaggttaaggtgggaggattgtttagttttttttattatttggttatagaatttttttttaatagaatatattttggaaagtaatgatttaatttatttatttttttattttttttttttgtattgaaatggtggattagttatgaaattatgaaagtttgggttaggtgtggtggtttatatttataattttagtattttgggaggttgagaggggtagattatttgaggttaagagtttgagattagtttggttaatatggtgaaatttcgtttttattaaaaattagttatgtttggtagtatatgtttgtaattttagttatttgggaggttgaggtaggagaattgtttgaatttgggaggtaaaggttgtaatgaggcgagattgcgttattgtattttagtttgggtaataagagagaaacgtagttttaaaaaaaaaaaaaaaaaaaaaaaaaaaagttagtttgttgtggttaagttaaattattaatattagtgtatttgagttaaaggaaattggtttttttttgttatatgtaaatttattttatttttggggatttatgtaaggtagattgttagaaatttgggtggggagggtgtaggggtagatttatagatttattttgtttttaaaaaaaaaaaaaaaaaaaaaaaagagagatagggggttttattgtattgtttagattggattttaatttttgagtttaaataatttttttgttttagtttttggaatagttgggattataggtatatgttattatatagggtttatttttttgatttttaaaaatatattttttaataaatttgtattttattttttttattatgtttttttagtatttgtatattttttaattaaaattttttagattttttataattatttgttttaaatatttaaatttttggttaggtgtagtggttgtcgtttgttagtttagtattttgggaggttaaggtaggtggattgttttagtcggttttagattagtttgggttaatatagtaagattttgtttttattaaatatataaaaaattagttaggtgtggtggtatatatttgtagatttagtaaattgagattgttgtgagttgtgattaggttattgtattatagattgggtaatgggagtgagattttatttttaaaataattattattattattattattattaaattttttattatagtagggtttaagtaatttggtatttattgattttattttttatttttttttggtttttgttatattttaggtataaaagttttttgttttataaattggttataagagttttttttgattataataatgtttattttttaatttgataatggatattatttagtatttagtttattgttaattttttaaaaaggttttttacgattattatttatattatttttgttttattgtgttagtaattatttttatttgaaataaatttttttgtcgttttatatatatattagattgtaagtttttgagggtagggattttcgtttgtatgtttaggatttttagtattatttggtatatagtatatatttagtaagtatttgttgtatgaattaaaggataagttataatatgttagttatttagtaaaatatgagtttttagttaagattggagattatttttttagattaattattagtagttttaatataatgtgggaatttagttgtatgaatgttagatgaataaatgattaatttaattgttataattaaatttgtttatttaaaagtattttaagaaagtgaatttttagatttgttttggtttggtagaatggtttatgtttgtaattttagcgttttggaaggtcgaggcggaaggattatttgaggttaggattttaagattagcgtgggtaatatagtgagattttgtttttataataaataaaaattagttaggtatggtggcgagtatttgtagttttagttgttttggaggttgaggtagaaggattggttaagtttagaattttaaggttgtagtgagttatgattatgttattgtattttaatttgggtaatagagtaagattttgtttttgaaaaaagataaaatttattttgtattatttgtttaaatatgttagtgattttatttttgttttagggttttgtatttattattttttttgtttgtagagttttgtatacggaaagttataaggtttgtattgtttattttatttttatttaggatttttgttttttttggagataggggtttttgttttgttatttaggttggagtgtagtggcgtgattttagtttatcgtagttttcgttttttaggtttaagtaatttttttgttttaattttttaagtagttgggattataggtgcgtgttattacgttcggttgagttttatatatagtaaagatgcggttttatcgtgttggttaggttaattttaaatttttgattttaggtgatttgtcgttttagttttttaaagtgttgggattataggtatgagttatcgtgttcggtttggaaggattttttttaaatgttattttttttttagagatgttttgttgtattattttatttaaaagagtatttattttagttattttttatgtttttattttattattttttaagtatattttattaggtatattaattttttttgttatttattgtgtttttttttttattagattgtaaattttattgatagtagggattttgtgttttgtttattgttttttttttagagttttataatagtgatgagtattcgttatatatttgttgtattattttaaaaagttagatatttttgatgtttttattaaaaatattattttttatttttattttggttggttgattgtgttaaatagaaagaggtggatataattttttagattttaaaattataataggttgagtaaggtggtttatttttgtaattttagtattttgggaggtggagatgggacgattatttgattttaaggatcgtttaagattagatttggtaataatagtgagattttgtttttataaaaaattttaaaaattagttgggtttaggtcgggcgcggtggtttacgtttgtaattttagtattttgggaggtcgaagtaggcggattatttgaggttaggagttcgagattagtttgattaatgtgatgaaatttcgtttttattaaaaatataaaaaaaaaaaaattagtcgggcgtggtggtatgcgtttgtaattttagttatttaggaggttgagataggagaattgtttgaattcgggaggtagaggttttaatgagttaagattgtattattgtattttagttttagtttgggtaataaaagtgaaatttttattttaaaaaaaaaaaaaaaaaaaaaaaaaaattagttgggtttggtgatatttttttgtggttttagttattagggaagttgaggtaggaggattgtttgagttcgggaggtttaggttgtaataagttgaggttttgttattgtagtttagtatgggtgattgagtgaaattttgtttttaaaaataaaataaaataaaataaaataaaataaaaataaataaataaaattatataatagaatgaaatttaaaatgattaagttgagatgttagggtaggattatttttaagtttaaaaaaaagtgaggggttatataaatatgtatgttataattttttaaagttaaaatattatatagattttagaattttaatatttttttttgagatagggtttgggtttgttatttaggttggagaaatgtagtggtgtaattttggtttattgaaatttttgttttttgggtttaagttatttttttattttaattttttaagtagttgggattataggtatatattattatatttggttaatttttgtgttgtttttgtagatatggttttagtgttgtttaggttggtttggaatttttgagtttaagtgattcgtttattttggttttttaaagtttattttttgggaatattttttaaggaattatttgttaataaattttttttatatcgttttgtagatatagtttataaaatcgaattttaagtttatttttaatttgagaaaataagagaaattagggatttttagagaatattttataggtatttataattattaataagattaagttttaattattttatgtaattataagtaaaggtattttgatattttgaaatattagtaatatataaatgtaaaaagtgttattgatttaaaaatgatttaaattagaaataaaatatttattttggttaagtagggtggtttatgtttgtaattttagttttttggggggttaaggtaagtagattggttgagtttaggagtttgagattaatttgggtaatatggtgttatttttataaaaaaaaaataaaaattagttgagtgtggtggtgtacgtttgtagttttagttattcgggaggttgaggtaggaggatagattgagtttaggttagtttaggtaatatagtgagatggtgtttttaaaaaaaaaagggagggagaagataagaatttatttttattatttttaaatgagggggtgatatttttttttttttacgtaattatttttggaaatttttattaatatataattaagaaatttaaaaaagtattataataaattagttatggtagatatttaaatttttaagttttttttgttgaatgaatggttagatttaagtttagtatttttttataggtttttaattataggtggagatttttggaataaaagttttgttttttaaagttattttatagatatttgtgatataagttgatttaagatgtttgttttttttttagatatgtttttaatatattagagaattattttcgaggttttatatttgggaagagggaaagagatttaatgaatgaaaattatttggtatttatatatgaagaatatattttaatattttaatttattttttgttttttaattataggaatatattatttagaattaaatttaaattttttatattgtttataaagttttttatgattcgggttttggatattttttttttttttatgtaatattttaggaatttaagatattttttaaatattttaatattttaagtcggtttttgtttttgagttttgagttttttattttttttatttggaatgttttgttttttattttttaatggttggtttttatttaaatgttatttttttagaaaagttttttttatttgttatataattttgttattatttgaaattatttaatgttttttttttcgtttacgagaatatatggtttttaagggaagggattttgtttatttttgtttttttattatatttttagagattaagtggatgtttaataaagttattaaatgaataaagaaataaattaattttaaaattagagtattgtttttgtatttatttaattttgttttagattttaattagtagaagtaattagaaggggagagagattttttttgtattgatggtaagaagtgaaagataaagggttgtaggagcggagagacgaggtttattaggattttttgaaagtatgttaaaaaaaaaaaaaaaaaagagagagatatatatagagaaaggttaaagatatgattatgtgggtttaaggtgagaaaaagagtaattggtggaatttaagattaaagggtttttttttgtgtttttaaggaagaataatatttgtgtatttattatgtggtaagtataggtgggatggtatttattagggagagagaagtaagtaagatagataaggtttttgtttttaaatagtttatattttagtagttgagaaagataataagtaagtaataagtaagtgttagtaaatgttatgaagtaattaaaattaggtgatgttgatggagagttatgggagaaaggttttagataggttgattagatagtttgattaatatggtgaaatttcgtttttaataaaaatataaaaattagtcgggtgtggtggcgtgtagttttagatttgtagttttagttattcgggaggttgaggtaggagaatcgtttgaattcgggaggcggaggttgtagtgagtcgagatcgcgttattgtattttagtttgggaggtagagcgagatttttttttttaaaaaaaaaaaaaaaaaaaaaaaaaaaagaaaagagaaaagaaaaagaaaaagaaaataaaagaagaggttggttaggggaggtttaaggtgagggaaatttgggagaggcggtttgttttgtaaaaatgttggtatttttttagtaaataaaaggtatgtgtaaataattttaaatcggaataattttggaatatggaagaaatagaaagttatattggttaaggagaaagatgggtgggagagatgaataaataatcgttagtttttagggaatttttgtaaattacggtaaataatttagcgtatttttaaagttatttttcgaggtagattttgttattaattttattttgtagttaaggaaatggaggtttagtgagatgaggtgattagttttaagttatatttttaacgagaggttacgtttggaatgaatttaggcgatttaattttaaagtttatgtttcgaattattatagtatagcgttttttttaaaacgagggaatttttttttaattcgcgttataggggatttttatgtttcgggtgtatcgattagaatttttataaataatttagtaaagtgagattacgatgttcgttttatagttagggatataagtatagaggttagagaagggtgagttcgggggttttattagagttagggtaagggacgacgcgaggtagtcgtagttttacgcgttcgtagttttcgttcgggtaggtttcgtcgtcgtatatttagttcgcgcggttagtagttatcgtcgtagagaatggatatgcgagcgcgattaataaggagcggttttttcgagcggagaggcggcggcgtagttaattagcgtcgtgatggagaggaaagggcgggtaattcgtaggttcgcgttaggtcgcgttttagttgtttttagtttttataggttttggggtcgtcgtatttgggttagagatttaggatgtcgcgaggcgcggtaagcgttttttagggaagtcgaagattttgtttgagcgtattattcgaatttcgggtttatatttcgttttcgtttagaggcgcggtttttattttttagcgttcgttagtatcgggagcgttttattttttttttagttgggttttaagagttattttggtaggtcgtgtacgtttcgcgttttatttcgtggggatatagaaacggaggagggaattttagtcgcggatcgtagttggtattattcgtttttgtcgtcgtttcgttttatatttaaatttcggtaaaatggcgcgatagcgagtttgaggttagagcgtatgagcgagcggttcgttgtagggggcggggttaggaatgttttggttttatttaagttcgaagggttaatcggggtttcgttttgtttttgcgttgattttataagtgataatgttttttggttttgattatgttagtaggttttacggttttcgttttttaaagaggaatatagatttagcgagcggttgttggtttttgatttattttgatgttagggtttggtacgtaggaggtgtttaatgttgatcgatttaaggtcgtgtatatagggtttaagacggaagagaattttttgttttttttggagtttttattttagagggagatacggttagataggtttcgaatttttggttttaagtgattcgtatattttggttttttaaaatgttgggattttaggcgtgagttatcgcgtttggtttggtatgtaagttttggtatttttattatagtttataaattatatgggatttggtttttgttagtttgtttgtttttattatttttcgttttttttttttttttatttttatttagtttcgttattttattttttttttgtttttttaagttttaagtttatttttattttagagtatttatatttgttgttttttgtgttgggatgttttagatttttgaatgattggttttttttttatatttaggttttagtttaaatgttatttttataaaagaggtttatttgaaattgtttatttattattatttagtatataaattagggttgttaggtttagtaaataaaatgtaggttgtttaggttaatgtaaattttagaaaaaaatttataattttttagtataaatattgtgtaggatatatttatatttaaaaattatgtattgtttatttgaaatttatattgaattgggtgtttagtgtttgatttggtaagtttagttttatgatattattatggtatttattattttttaattaattgttttttttttattttgttttttttttcgtttttttttttttaaatttttgtttttttttttatttataatttaagggattttatatagtaagggttttttttttttttttttttttttaaagatagagttttgttttgtcgtttaggttggagggttggagtgtagtggtgttgttatagtttattgtaatttttgttttttaggtttaagtaatttttttgatttagttttttaagttattgggattataggtgttcgttattatgtttcgttgatttttgtatttttagtagatacggggttttattatattggttaggttgattttgaatttttgattttgtgattcgttagttttggttttttaaagtgttgggattataggtatgagttattacgtttggttagggtttttttttttttttttttttttttttaagaggtagggttttgttttgttatttaggttgtagtgtaatggtataattatagtttattgtaatttcgattttttaggttaaagtaatttttttattttagttttttgagtagttaggattataggtatttgttattatatttggttaattttgaatttttttgtagagatgagtttttattatgttgtttaggtaaatttttggttttaagtgatttttttattttcgttttttaaagtattgggatagggttgggtatggtggtttacgtcggtaattttagtgatttgggagatcgaggtaggtagattatttgagattgggagtttgagatttgattaatatggagaaatttcgtttttattaaaaatataaaattagtcgggtgtggtggcgtacgtttgtaattttagttatttgggaggttgaggtaggagagtcgtttgaattcgggaggtagaggttgcggtgagttgagattttgttattgtattttagtttgggtaataagagcgaaattttattttaaaaaaaaaaaaagtttcgggattataggtgtgagttattatatttagttttatattgatggtatttatagttgtatttttagtattaggtatatagtagttgtttaataaatgtttgttgtatgttgaatgaaatgttatatataaataagtgaagtttatggagaaagatatatgagtgaaagatattggtgaggtcgggtacggtggtttatgtttgtaattttagtattttggaaggttgaggtaggcggattatgaggttaggagatcgagattattttggttaatatggtaaaattttgtttttataaaaatataaaaattagttagatgtggtggtatgcgtttgtagttttagttatttaggaggttgaggtaggagaatcgtttgaatttgggaggtagaggttgtagtgagtcgagatcgagttattgtattttagtttgggtgatagcgagattgtgttttaaaaaaataaataaataaataaaataaaaataaaaataaattatgatggttagaagacggtggaatattttaaaaaaaaataaagatattggtgaaaaagatgtatttttattattgtagtaatagtattagtaattattagtaattattttaatcgttttaatttgtatttttttttttttttgagacggagttttatattgttgtttaagttggagtgtagtggtgcgatttcggtttattgtaaattttattttttgggtttacgttatttttttgttttagtttttcgagtagttgggattataggcgttcgttattatgtttagttaattttttgtatttttagtagagatagggttttatcgtgttagttaggatggttttgattttttgattttatgattcgttcgtttcggttttttaaagtgttgggattataagcgtgagttattatattcggtttattaatttattttaatataattaatatgtttttttagttttagggagaatgagtttgatgattttattattttttatttttaagagttaatcgtaaaggaggttggttggtattttgtgtttgtttagtatttttattagtttttgtagaaaatttttaagttgtgttaagacgattatgtttggatatagtttttggtgttacggggtgtttttttttattgtttatcgttttttgtagttattagaataattatgtaggtgagagttatagaaaggttgagtgtttttttttattttgtatggtttatgggtgatagttaaagatttttttgggaattttttttattttagttttattatatgtatatatttttggggcgtgttataatttttaatagattgtgttggaaattaaagaaaataatttatttattttaaggagtaggagattaagtatttatttatgtagttttttttttttttaaatttttataaaataatttgtttaggttgggtatggtggtttacgtttgtaattttaatattttgggaggataggatgggttattcgaggttaggagttcgagattagtttggttaatattgtgaaattttatttttattaaaaatataaaaattagtcgggtgtggtggtgggtgtttgtaattttagttatttgggaggttgaggtaggagaattatttgaatttgggaggtagaggttgtagtgagttgaggtcgtattattgtattttagtttgggcgataaagtaagattttgttttttcgcgtaaaaataaaaaaaattttaatttgtttaatgtaaggaaagatattttgaaaagatatattgtttatggtgtgttttttgaggaagataattttatattttatttggatttagaagggcgtggatatatttggttatgttgggaaagaataagttttatgttttaatttcgtttttaaagtttaattgagatgtagaagagtgttaatagttaaatattgagaagtatttgattgttgttttttattttttttaaaatggaggtattttaatttttttttttttttttgagatggaattttattttgttgtttaggttgtatagtatagtggcgcgattttggtttattataattttcgttttttaggtttaagtaatttttttgttttagttttttaagtagttgggattataggcgtttattattatatttagttaatttttgtatttttagtagagatggttttattatgttggttaggttggttttgatttgattttaggtgatttgtttattttggttttttaaaatgttgggattataggcgtgagttattgtatttggtttatttttgtttaaatatatgtttatatgttataaaaatttatacgtttgagattagtttgattaatatggtgaaattttatttttattaaaaatatgaaaattagtcgggcgtggtattgtgtgtttataattttagttatttgggaggttgaggtaggagaattgtttgaatttaggaggtagaggttgtagtgagttgagattgtattattgtattttagttgggtaatagagcgagattttattttaaaaaaataaatttatttatataaaatgggaaattttttttattaattaggatataagttgtaggtaatatattatgttttttatttttttattttatatttttttaattaaaaatttttaaatgtatatatttaaatttttttttgtagggattgggtttttttgtgttgtttaggttggttttaaatttttgggtttaagtgttttatttattttggttttttaaagtgttgggattatagtggtttattgtaattttcgttttttaggtttaagcgatttttttgttttagttttttaaatagttgggattataggtatgtgttattatatttagttaatttttgtatttttagtagagatggggttttattatgttggttaggttggttttgaatttttgagtttaggtgatttatttgttttcgttttttaaagtgttggaattataggtgtgaggtattacgtttgatttagaagtgtattt

SEQ ID NO: 207 - DNA, 5476 bp, Artificial Sequence
  chemically treated genomic DNA (Homo sapiens)
ttgtttttatgtttgagggaaaaaaagttgagatattgtatgaaagatgatgtaggatatacgttgattttttggttttaatgagttatttgaatattgttttgtttattgttagttttttttattatttattatatggttaatttttgaatttttgtaatatgaaattttattttattttttaatttattgttatttaaagttagtaagtttagattatatggttatttaaaaaaaaaaaaaaaaagaaaagaaaaagaaattttttatagttttatttattaaataagtaaattttaataataagtatttgtgttttggtaatttatagtggatgtttagaaaagtaatatataaagagaaatgtttatgttatttgtttagttatgggatgtgtgtgtttgtcgagtatttttttaatttggaatttggtagaatatcgttatttttattgttttatttttttacgtcgatttttatagtaattgtttgtttagtgattgttataatttagtttggtagagagagggaagatattttataaagtaaggtaacgttaatgttgagattatgaatggttttgagtagagtagagtattattgttttttttaaaatttagaaggatttgatggtgttttgtgagtttatgggggtgttttcgtgtaggttggaaattatagttgtgcgtttttttcgtttttttttttgattagtagaagggtattttttttggtttgtacgtcgttgggttatataatattggttgtcgttgtataaagttacggttattagcgtttttttgaggttatttgtttttagttatggtgtttataggattttttttttattttgtaattttagttaaattagagtatgtgatttggtttagatgttaatataattgttgttatgtgtttttttttttttttgtgtttgtgataggtttaatttaatttgagaaggttgtagattttcggggttggtgtaaaaatattttattttgatttgagaaggcggttagttttttttttcgttgtcgttggttgttagtatttattttttgtggatgtgaaaattttagaagggttgggttttttttttgggtattttttaggtttatttttagagtggggtttagtatgggaggattgtattttatttatttttttgatgtggggtttggatttatagttcgatagtatttatggaatgtgggtagaagcgatagtagttagtttcgttttggttttagggcggtacgtgttttgtttgtgttttgggagtttttattttttatattgtgggaagagggtgtttagggagttgtagtttttttagtttagttttaggacgaggtttaggtagtagagttattttagtagatttggtagtgtgagagaaatgtatgtgtatatattgagtttgtaggtggttgttatatggtagtattgattgatatagatagaaaagagatttacgagggagaagtgagagtgttggagattttataagttataggttgtaggggtaggatggttttttagaaggtgaaatgattgttttgggaatttattagaggaagatatagaggttttagacggttgaaggtttaatagtgattttagacgggttttatgttagattaggtttttttagggttgtgttgtttttattaaagttcgttttgagggtagttatatagtaggtagtattcgttatttgtataagcgaggtttaagttttagttttttttttggtaggtagaggaagtaggggtattatgtttgggagtttttgaaagtagatggggtagtatttggttaagagttaggaggggatgatagattagaggggaattttcgttttacgtgttgagtatacgtagggggttgggtatttgttttgtgagttataattggtgtttttgtgtttcgtcggaagttgtattaggtagttttttggtggaggatagtggtcgttttttagttttattttttttttcgtgatgggtcgttgttagatgtgtgtttaggaaaggtaaatattaaaggtagaggattagtttttatatcgaatatttcggtggttttgtttgggggttgggttttgacgtgttggaggttgttttagatttagagattaaaaatagggaagaattattgttgaaatttttggaaaagtttgtaatggggtttttggtagtttgaggagtggtggtgtttttatttggtagacgtcgttttaataggagggatagatgagtgtattagtgttgttagttagaggcgtttgttggcgtgtttttatggaatggggtgttagttttgtggagggtggtttatttttttgtttttagtttttattgggtttgttttttgttttatggttagttggttagatcgagtatttttttgattttcgattttggtttttgttgatttttgtcgttgaggttttttgtagattttatttgtatttattttttgtagtttttatatttgaatttcgtttggatttttgttaagttttttaggttttttttttttagggggattatagatgttacgtgtagggttgtttttggagggttagtatagttttttttaagtgggtaagatttaggggtggtttaaaagatagttgtgttttagttttggaatttttgaatgttgatttttgtagtaaaaaaggatttgtagatgtgagtaaaggttgttgagataaggatattttttttgttttttgggaggattttaaatgtaggtgtatagattttaagaagaagaggtagagattggggtgatgtagttataattaaggaaagttaaggattgttggtagtttgtagaaattggagggtaaggagtattttttaatcgttcggagtttttaggaggcgtaaggttttattgattttttgattttagacgtttagttttcggaattttgagaggatttatttttgttattttaagtaattaaatttgtggtagttttattagttttaggaaatgaatacgaatggaaagttaaagattttaagaaatgagtggcggggtgcggtggtttatatttgtaattttagtatttgcgggaagattgtttgggtttaggatttggagattttgtgtttgtgagaaatttaaaaaataggttgggtgcgatggtttacgtttgtaattttagtattttgggaggtcgaggtaggcggattataaggttacgagtttgagattagtgtgattaatatggtgaaattttgtttttattaaaaatataaaaattagtcgggtgtggtggtgcgtgtttgtaattttagttattcgggaggttgaggtagaagaattgtttgaatttaggaagtagaggttgtagtgagtcgagatagtattattgtattttaggttgggtagtagagtaagatttcgttttaaaaaaaaaaaaaaaaaaaaaaaaaaaaaaaaaaattgagtatggtagtatgtatttgtggttttggttacgtcggaggattgtttgaagttaggagtttaagattagtttggataaaagagtaagattttatttttattaaaaaaatttaaaaattagttaggtatggtgtcgtatttatagttttagttatttaggaggttgaggagggaggattatttgagttttggcggttgaggttataatgagttatgattgtgttattgtattttagttttggtaatatagtgtgagattttgttttaaaaataataaaaatttaaaataaaagaattaagaaattattggatttgaggtttggtttttagttgttgttttgtttttgtgatttggttattcgggattttttgggtttaaatatatagtttattgtttattttaagaaggttttttattgtttggttggtaattggggtgggttttgtaggttttatttgttttggttttacggcgttggtgttgtaggtttttattattgtttgtttcgagttttttagttttttgtagagttgtttgtatttgatggcgatgaattaggaaggtaggcgtgttttgggttatagagtagttatggttgttagttattagggggttttatttgtaattttggatgtggttttggtttttttgtttaaagtgattttggggtttttagataagagatagggagattggagtttagttttattttttcgtatatatttggtttatttttgttttattttggaagatgggggttattatacgtgtaagggatacgggataggaatttttggttttgttattagatattttaaaattaagtgtaaacgtgattattaggtgtagtttttatagtagtaagaaatttgtgtttatagaaagaaatacgtgttagtaatttatttatgcggaaagttatatagagttattgttttttgtatttttaggtgacggtttatatttgttttagggaaggttatagttgtttgaatttttaaaatttttagatacgtattgtttgtgtaggattcggagtttagtagtattgttagggttttgaagtgtttttttagagatttttttttatagattatttttttttttttaagtagtaaaaggagaaaattgttattaaaggatattttagatttttgatagtattttcgttatttttgaggatattattattattttaggtgagtattaggtggagtgtttttgggtgattggtcggtttggagtagggagggaggtttagagttttattttttagtagcgagtgaggcggaggttttagcgtttttttcgggcgggttttttggtggatggaggagtgattcggggttttttacgtggtgttagttgtttggttttttggacgttgtaggaaagggtttttttcgtttgcgtttttttgattttgagttttattagtttttgttagttgggttttagaaggttggagtgttgtggtagggatgacgttttatttttgttatgtttttgtgttttgtgtttttttaggatgaggggtatgaagttgttgggggcgttgttggtattggcggttttattgtagggggtcgtgtttttgaagatcgtagtttttaatatttagatatttggggagattaagatgtttaatgttattttcgttagttatattgtgtaggtgaggttagggtagtttttttttaaaagtagaggagttttggagtttagggttggtgggtagggttagttttatggagttatagggtgtcgggtgtggggtattgagtattattgtttttagtacggtggaataggtttttggttgtggattaaggtttttatttttgttgtgttgtttttggttggtagtaggagtttaggtagaaatatgaggttgcggttaaatcgagtaatgttacgagtattagttgtggttttttttgtggcgttgtagggtttttgggtggtattagttttgtttagtattattgtggttttgtttttaga

SEQ ID NO: 208 - DNA, 5476 bp, Artificial Sequence
  chemically treated genomic DNA (Homo sapiens)
tttgggggtagggttatagtggtgttgagtagggttggtgttatttagggattttatagcgttataaagggagttatagttgatgttcgtggtattgttcggtttaatcgtagttttatgtttttgtttgggtttttgttgttagttagggatagtatagtagggatgaggattttggtttatagttaagagtttgttttatcgtgttgggagtagtggtgtttagtattttatattcgatattttgtggttttatagggttggttttgtttattagttttagattttagagtttttttgtttttggggggaggttgttttggttttatttgtataatgtagttgacgagggtggtattggatattttggtttttttaaatgtttggatgttgaaggttgcgatttttagggatacggttttttgtagtagggtcgttagtgttagtagcgtttttagtagttttatgttttttattttgggagagtatagggtatagagatataatagaagtgagacgttatttttgttatagtattttagttttttggagtttagttggtaggggttggtggagtttaaggttagggggacgtaggcgggggaaatttttttttataacgtttagaaagttaaatagttggtattacgtagaggatttcgagttatttttttatttattagaaaattcgttcgggagggacgttggagttttcgttttattcgttgttggaggatgagattttaagtttttttttttgttttaaatcggttagttatttagaggtattttatttggtgtttatttgagatgatggtgatgtttttagagatgacgagaatgttgttaagaatttggaatattttttgatgataattttttttttttgttgtttaaagaaaaaaaagtagtttatgaagaaaggtttttgaagaagtattttaaggttttggtagtgttgttgggtttcggattttgtataggtagtgcgtgtttgggagttttaaaagtttaggtagttgtgattttttttggggtaaatgtgagtcgttatttgagagtgtagaaaataatggttttgtgtggtttttcgtataggtgggttgttagtacgtgtttttttttgtaagtataggttttttgttgttgtaaaaattgtatttgataattacgtttgtatttagttttaaaatgtttgataataaggttaaaggtttttatttcgtgttttttgtacgtgtggtggtttttattttttaggatagggtagggatgggttaggtatgtgcgggagggtggggttgggttttagtttttttgttttttgtttgggggttttaaggttattttggataaagaggttaaagttatatttaaagttgtaaatggagttttttggtggttgatagttatgattgttttgtggtttaggatacgtttgtttttttgatttatcgttattaggtgtaggtaattttgtaggaggttggggagttcggaataagtagtggtgggggtttgtagtattagcgtcgtggggttaggataggtggggtttgtaaagtttattttaattgttagttaagtagtggggagtttttttgaggtagataataggttgtgtgtttaggtttaggggatttcgagtgattaggttataagggtagggtagtagttaaaggttaggttttaggtttagtaattttttggtttttttgttttgggtttttattgtttttgagatagggttttatattgtgttgttaaggttggagtgtagtggtataattatggtttattatagttttaatcgttagggtttagataattttttttttttagttttttgagtagttaagattatgggtacggtattatgtttggttaatttttaaatttttttggtagagatggggttttgtttttttgtttagattggttttgaatttttggttttaggtaatttttcggcgtagttaggattataggtgtatgttattatgtttagtttttttttttttttttttttttttttttttttttgaggcggaattttgttttgttgtttagtttggagtgtagtaatattatttcggtttattgtaatttttgttttttgggtttaagtaatttttttgttttagtttttcgagtagttgggattataggtacgtattattatattcggttaatttttgtatttttagtagagatagggttttattatgttggttatattggttttaaattcgtgattttgtgattcgtttgtttcggttttttaaagtgttgggattataggcgtgagttatcgtatttagtttattttttaagttttttatagatataaggtttttaagttttgagtttaagtaattttttcgtaaatgttgggattataagtgtgagttatcgtatttcgttatttattttttggaatttttgattttttattcgtatttattttttgagattggtgaaattattataagtttggttgtttaaaataatagaaatggatttttttaaaatttcggagattggacgtttgaagttagggagttagtaggattttgcgttttttggaggtttcgggcggttgggggatgttttttgttttttagtttttgtaggttgttagtaatttttggttttttttagttgtggttgtattattttagtttttgttttttttttttaagatttgtgtatttgtatttggggtttttttagagagtagggaggatgtttttattttaatagtttttatttatatttgtaagtttttttttgttataaaaattaatatttagaggttttagggttagggtatagttattttttgagttatttttgggttttgtttatttggaaggggttgtgttggttttttaaggatagttttgtacgtagtatttgtggtttttttgggggaggagggtttggaaggtttggtagaagtttaggcgggatttaggtatgagaattgtaggaaatgaatataaatggggtttgtaggaggttttaacggtaagagttagtaggggttaaggtcgaaagttaggaaagtgttcggtttggttagttggttatgaagtagaaggtaggtttagtggggattagaaataggaaggtaaattattttttataagattggtattttattttataaagatacgttaatagacgtttttggttggtagtattggtgtatttatttgttttttttattgagacggcgtttattagatggaaatattattattttttaggttgttagaggttttattgtaggtttttttaaaggttttagtaatggtttttttttgtttttaatttttaagtttaggatagtttttagtacgttaaaatttagtttttaagtaaggttatcggagtattcggtgtagggattagttttttgtttttggtgtttgttttttttggatatatatttgatagcgatttattacggggaagggagtaaagttagagggcggttattgttttttattaagaaattgtttggtgtagttttcggcggggtatagggatattaattatagtttatagagtaagtgtttaattttttacgtgtgtttagtacgtgggacgagggtttttttttggtttgttatttttttttggtttttgattaaatgttgttttatttgtttttaggaatttttaggtatagtgtttttgttttttttatttgttagaaggaaggttggaatttgggtttcgtttgtataaatggcgagtgttgtttgttgtgtggttgtttttaggacgggttttggtgagggtagtatagttttggaggagtttggtttgatatggggttcgtttgggattattgttgggtttttaatcgtttggagtttttatgtttttttttgatagatttttagaataattattttattttttaagaagttattttgtttttgtagtttgtggtttgtggagtttttagtatttttatttttttttcgtggattttttttttgtttgtgttagttaatgttgttatgtaatagttatttgtaaatttagtgtatatatatgtattttttttatattgttaggtttgttggggtggttttgttgtttgggtttcgttttggggttgggttggagagattgtagttttttgggtattttttttttatagtgtggaaggtggaggtttttagggtataagtagaatacgtgtcgttttaaggttaaggcggagttggttgttgtcgtttttgtttatattttatgggtgttgtcgagttgtaggtttaagttttatattaggggagtgagtggggtataatttttttatgttgggttttattttggagataggtttggggaatgtttaagaaggaagtttagtttttttgggatttttatatttatagagaatgggtgttggtagttaacggtaacgaggagaaaagttgatcgtttttttagattaggatgaggtgtttttatattaatttcgaggatttgtagtttttttaggttaaattaaatttgttatagatataggaagggaaaagagtatataataataattatattgatatttaagttaggttatatgttttgatttggttgaaattataggataaaggaaaaattttataggtattatggttggaaataaatggttttaaaggaacgttggtggtcgtggttttgtgtaacgatagttagtgttgtgtgatttagcgacgtgtaggttagggagggtatttttttattgattaagagggaaagcgggaaggacgtatagttgtggtttttaatttgtacggaggtatttttatgaatttatagagtattattagatttttttgaattttgaaggaagtaatgatattttgttttgtttaaggttatttatggttttaatattaacgttattttgttttatagggtattttttttttttttgttaggttgggttgtggtagttattgaataagtaattattgtgaaggtcgacgtggaaaaatgaggtaatgagggtggcggtgttttattagattttaagttgaagaggtgttcgataggtatatatattttatgattaaataaataatatgaatatttttttttatgtattatttttttagatatttattataagttgttaggatataaatgtttattattggggtttatttatttaataaatggaattgtgggggattttttttttttttttttttttttttttttttgaatgattatataatttggatttattaattttaggtaatagtaagttaaaagatagaataaggttttatattataggaatttaaaaattgattatataataaatgatgaagaaaattaataataaataggataatgtttaaatagtttattggggttaaaagattagcgtatattttgtattattttttatgtaatgttttagtttttttttttttaaatataaaggtag

SEQ ID NO: 209 - DNA, 11812 bp, Artificial Sequence
  chemically treated genomic DNA (Homo sapiens)
tgtaagttttttttagagaatgttgttttttttttttttgtattttttggatttagaatagtgtttagtatgttgtaagtatttagtttaaattgaataaattaataattattatttataagattgaaagtttttgtggttacggattaatatttattgattatatatttttagtaatatttagtttagtattttgtatgtggtaaaagtttagaatgtttgttaaatagaattgtattttatttttttttgttttttaaagatgttttttgtttttttttggaaagtttttatattgttatttgtttttttattttttatgttttattttatttttgtttttttttttgtttatattttattataattttttgggattttaggaaattttaaattataattgttattttttaatttttagaggttatatagattatgttttataatttagtagtttatattaatatgtattttttgttttatgggtatttatttttgtttttttaataatattgtaaatggtataatggtagagattatataatatttttatattattgaaaatatataaggtgatatgtattgtaagtaatcgataattatattaatttatttagaatagtatttttatttgtttattagatatgattatttagatatttaatagagattttattttgtttgaaatagaattttttgtttaagtatttatgtatatttttttgttattttattttatatattggttattagaagggatttagttttttaagtttaaagtgtaggaataaattttttaattttgaaatagaagatttatatgtagttgtaagattaatttgtaagtataggggagattttatttgttttttatttaatttattttaatggtaatattttgtaaaattataatatagtttagtatatttttaaattattaaatagagatgtaatttagtaattttatttttatatatatatttgagtaaattgaaaatatatgtttataaaaatatttgtgtacgaatgtttatagtagtattattattattattattattattattattattattttgagatagagtttcgttttgttatttaggttggagtgtagtggtgcgattttagtttattgtaatttttatttttcgggtttaagtgatttttttgttttagttttttaagtagttgggattataggcgtatgttattacgtttggttaatttttgtatttttagtagagatggggttttgttatgttggttaggttggttttgaatttttgaatttaagtgatatttttattttagttttttaaagtgttgggattattatagtaatattatttttaatagttaaaagatggaaattatataaatttttatttatagatgaatgcgtaaataataagtggtttataattataatggagtattatataaatataatggttataaaaaggaatgaagtattaatatttgttataatttggatgaattttgaaattattatgtaaagtgaaaaaagtgggatattaaaggttatatattatacgattttatttatataagtattttgaatagggaaatttgtatcgataggaagtggttgtttagggttggagtgaggggaatggaaggataggggagttatttttaattaaagggtataaggtttttttttgaagtgatgaaaatgttttataattgattgtggtgatgattgtatttatttgtgtatgtttgtggaattgtatattttaaatgggtggattgtttggtatataaattttattttaataaagttgttgaaaataaaatataaattatagtataatagtataattaggataatgatatagttaagattttgagtattttattattataaaaatttttgttattgttttttatagttatttttattttttttttatttttatattttttttaatttttggtagttattaatttagtttttatttttataattttgttatgtaaaaatattatgtaaataaaataatttaatatgtaatatttgggaattaattttttttttttgaaatggagttttattttgttgtttaggttggagtatagtggtgagattttagtttattgtaatttttatttttttggtttaagtaatttttttgttttagttttttgagtatttgggattataggtgtacgttagtatgttttgttaatttttttgtatttttagtatagacggggttttattatgttggttagattggattcgattttttgattttaggtaatttatttgttttagttttttaaagtgttgggattttaggtatgagttatcgcgttcggttgggaagtaatttttatttatttagcgtaattttttggaaatttattaaggttgttgtgtgtatagttagtttttttttttttagttgagtagtatttttagaaattattttgatttttatttttttttatttattatatttaatttaggagtaagttttgttggttttattattaaagtttattttagattttattttttttcgttatttgtatgaatatatttgtttatattattattagttttcgtttagtttgagaatattaaattgattttgttgtttttatttttgtttttttataatttatttattatataatagttagaatatattttaattaaaaatttttatattaggttaggtgtagtggtttatatttgtaattttagtattttgggaggttgaagcgagcggattatgaggttaggagattaagattattttggttaatatggtgaaatttcgtttgtattaaaaatataaaaattagttgggtacgtgtttgtagttttagttatttaggagtttaaggtagaagaatcgcgtgaattcggtaggtagaggttgtagtgacgcgagatcgtattattgtattttagtttggtaacggagagagatttcgttttaaaataaataaataaataaattttatattattttttaaaggtttattttttttttttatttatatatatatttaaaaatatttattgagtgttaattatatattgggtattgtttagattttcgagaagtagttattatatttaaaataatgataaaatttttgattttgtggaattaatataatagttagggaagattaaaagtaaataaaataagtaaaatattgtaaaataaaaaaaataaagtaggaaagtaagatgagaagtttttgtaggtaggttagttatatttttaaatagattggttagggaaggttttattgagtagatgatatttgagtaaaatatgaaggagatagggaaagagttatgtagataattgggagaagaatatttcgggtagaggtaatagtaaatataataggataagatgaaagtaggatgggagtagttgaggaattgaagggaaatttgtgtggttggagttaagtgagtaagaggggaatatttaggagatgaggttagagaggtaatgggtttagatgatttattggtttgttaggttatttataatatttattatattttttattttaaatgagatagtaagttttggagatttttaagtataatttgatttttaaaattttattttggttgttttatgaagaataaagtataggaggaagaggggaagtaaggtgattagtgacgaggtgatttttaaaattaaagtaggagatagtggtggtgtgtattagagttgaaatttcggaggtggtgtgaattgattgggtttgaatatgtcgtaaagattagagttaaaaggttttttggtagattttatgtatagtgtaagagaaaaagttaatgatgattttaaggttttgagtttggggaattgtatagatggagtggttatttatcgaggtgaagagtgtagttggagtaggtttggtaagttatatggggaaatttggtttgggataagtttacgttgaaatgttgggtatatttgagtttgggattaatagttagttttgcggttataatttgggagttgttaatgtgtagattgtatgtaaaggacgttattatttagggtattggtttagatggagaagaggtttaagatttttggggttttttaaaatgaaaaggtttaaaagatgagaagtaattagtaaaggatattgtagagtatttagaaaaaaattttatattttttattataattatgatttgatttttgttaaattttttaattttattttttagtatatataggttatttaatttttgaaacgtatatattaagtttttttttgttttatggttattgtttttgttgtacgttttaataattatgtttttattttggttttagttttaattattttttttttttattatagtttttagttaatttgttattttattagatttttttttaatttttttaatttttatttgagttttttttaattattttaattaaataggtttaatttaattatttttattaaattatggtttttattatatttgaaatttgttttatttattttttgtttaaaaatttatttttattttaataatcgtttataaaatgattagcgtatgttaaatgaaaaagtttagatatttttttttgtatgtaattttttggaaagtaggggtttttttatgttgttttttgtcgtattttaatgtagttatattgttttagtaattaattttgagtttttaatagttattaacggaatagattgtaagttattgattggtaatcgaaggttagtattagaaagaggatatcgataaatttataaatagagggatttgttttcgttattcgcgttttaacgtaaagggtgggataattcgcgcgtatgcgtcgttgttttttgttttttagggtaaatttcgtttttttttttaggttagttttattatagtatatgcgtagtataggatttgtttgttcgtttgtcggcgttattaataaagttttagtgagtatagatttttttttttttggtaagatggcggagtacgatttgattattcgtatcgcgtattttttggatcggtatttagttttttcgttttttgaatttttttttgtaaaggaggtgagggggtttttgggcgtaaggaaggcgtgggggcggatgaggtgttgagtaaggtcgaaaggtggtgtttgtagttttaggtttgatacgtgcgaggcggtcgcgagtttggtttttggacggatattaaggattttttggtagtttagcgtcgttttagttaagaagtatcgtattattcggtagtgaggaggagggaggttacggagagagaaaagaagttttttttatttattgaggtgttagtgcgggagggattttcgtattattttttttcggaagttggcgattcgttggtttcgttagagaacgttagagttttataggttggtttgtaaaagtaatttggagtgttgttagagtttttgattttttttttgggaattgtgggaagtttgggtttggttgtgggtttttgtatgtcgagttttttggagtgatttttttatatttaaaataagtatttagcgttttaatttttatgaagttgtgagttttttgcgtttttttgttttggttaagtaggattttttagaatagtatatttcgttagatggggacggcgttttttcgtttttttttttagaaaaaatttttttaatttttaaatgtgttttttagtggatatattgtattgattttatgtggtttgaattggtcgttaatatttaattatttatttaagatattatgaataaatgtgtaattttggaattttattttaaagtatatgttagttttaaaagttttattggatttgaaagttttggttaaaagaaaattgatattagttatatcgtgagtttattgggaaattgatgtattttaataatgtaaagtaatttgtagtgatgaaggaattcgaatttttttagaaaaataagtgagttttgtttttggaagtagattataatataagtttatttagggaattttagatttggggagtggattttgtgtagtaaaagataaaaagtaataaaataaaaacgttttaaaaattagcgtttaggtgttgtggttcgttagataggtataatttttatatttatatgtattttttttaaatatagataattttaaagttgttgacgttaggtaacggttaagattatttttagtaaatgtttaagaatgttttgttatgtaaaatttttttttgatatatttttgttttgatttttttttttatatttgtattttagattttgagtaaaatattcgtatttgtattgtttttttttttggaaaagtgaggataaaagatttagtaaaaatgttatattttgaaagtttttattagttgtttgtagaagtatttttgaattagttgaattttatatatttttgtgttttttataattttattttttttatggtatatagaaggaaaggaggaatatgtaaatgtgaattagatttttatagggttagacgaaaattatgaattgtaggtagttgagaattagtgggaaaaattgtttaatatttatttttttggagaaaatgttggtaagatagttgtaatatattaagaggaagatagatgttggagtatttaattagtaattgttaagtatatttgatttttggatagtataggggttaggaacgttgagttttcgtagttaaaaattcgttataagttttgatttttttaaaatttaatatattttaatgttgataggaaggtttattgagaatatggatagttttgtgttgtatgtgttttatattgtattattataataaagtaagttagagaaaataaaatggttttaaattataaggaagagaaaatatatttattttttagtaagtggaagtatattattatgaaggtttttattgtttttatattgagtaggttgaggaggaggagtaaaaggaggggttggttttgttgttttaggggtagtagaggtggaagaagtagaggaagtggatgggaagttaggaaaggtaggtatatttggtgtaatttttattgaaaaaaagttgtgtatacgtggatttgtgtggtttaaatttttgtcgtttaagggttaattgtatagggttatataattgagaaatttaagataaaatttagatattttattattaaataatttatttattttttagagttgaatgtttttgatataaggtaaaaataaatgtcgaagaggtaggtattggtagagtgttattaaaattgagattttgttatttttagtgagtaaagaggattttgaggaggtgaggttttgagttttgaaggtaaaatggttagaatagagttagtgattttgttatgtgaggatatagtagttttttttttttatatttttttagtagttttaatttttgtagttttagttatttatggtttaaaaatattaaatggaaaattttagaaattagtaattcgtaagttttaaattgttcgtttttttgggtagtaggatgaaatttgtttcgtttttttgtttaaaattgggatatgaattatttttttgtttaatgtatttatattgtatatgttaatttaattgttttattttgttattgtttattttttgtttttagtttataaattaaattttattataggtatgtatgtataggaaaaaaatagtaaatataggattggggttatttgtagttttaggtagtagtcgttggggggttttggaatatttagtttatggataaggggagattattatattgtattaagagaaaaatagttttatatatttgtagtatattggagaatataagttttatgagagtagaagtttttttgtgtttttagtatataatatgagtttggtataaaggttttttatgattgtttaataaatgattgaatgaatatatatttgttttttatttttttttatttttatgtgaagtagaaggttagatagtgaaatatttaggattttgggttttgaattggattttttatgattcggttatttaatatttttgtgtagttagagtagatttttttatttttttaatttttttttatgaataaaatgttaatattattattaattttatcgggttagaaaaattatatgagataatgtatataaaatattacgtttttttgggatagagtgagtattttttaatgttttgtgttttgagatagggtttcgttttgttatttaagttggagtgtagtggtataattttagtttattatagttttgattttttgggtttaagtaatttttttattttagttttagaagtagttgggattataggtgtgcgttattatgttcggttgattttttttgtattttttgtagagatggggttttattatgttatttaggttggttttaaatttttgaatttaagtgatttgttattttggtttcgtaaagtgttgggattatagatatgagttattatttttggttttaaatgttttttattttggaagattagtttattttgtattggtatgggatgggaggggggggtagtgagggttttgaggagtaaggtaaggattggaaatggttattaagaaattgattaaaggaaagtataaggattggttaagtgtggagggtttaattgagattggaaattatattttagagttaataatggggttatttttagggcgaggagcggtagaaggttatgggagtagtatagatatatttaggggtaggtttgtatgtaaatgttatttagagaagtatagatgtgatcgaataatattattttttaattttgaaatattttgtagttatttttagttagaatttagagaataggtgattttttttttagagttagtgattgatattgaattgtatatagttggagaaattagtttgaaagaattaatgatagaattgaagagaaaatttttgaaatagttaaaaatgatatttaaattaaggtagaaagtgatattaaaaagggtattataaaaattagaaagggtagaaagtttgagatgatgaagattttaatggtaatggtggaaggggttattagttttaagttggaatttttggagatgaggggttattagttttaagttggaatttttggagatgagatatatgatgaaaattgttataatttgaggaataaaggaattttagggtttaagtttttaaagagttattagtatggtattatatttgtgttgaatgatagtagaggaagagatagtaaaaaaagatttttaatttgttaaaaagtaatatgtttttaagaggttgatagacgacggattagtagattatagtttgggaattagatagtagtttgtttttgtgtggttttggggttaagaatagtttgtaatagaggaatatttgtaaatattagtaattatagaatattaattttatattttaattaagtgaaataattttttttgaaaaagtattttatttttattaatagatttgtattataaaaatttttattgttattatttttgttttaaaatttttaaaaaattgtggaaatttgattttcgttttttatgtgagtatttatatagtatttttaattgttgttttttgatataaagtttgaagtatttgttttttgtttatgaggtagaattgagaggtatatgtagatttgagaataggatagtaatatttgatggtagaggagtaaggttattgaatttattgtggagagagacgtggtaaattaaaagttattagtggagtggggagaggtagcgtgtttggaaaagaatgtttttatttaagattagtgtttttatagggtaaagtgatgagaagttaaggttttttaggtaaattttttattagatatgacgtttatttatataagtatataaatataaatgtattggttaatgatatatattttttttaaaatgaatagcgaatatatttatgtgattattatttagattaataaataaaatattatagatatttttttttttttttttttttttttttttttttttgagatagagttttgttttgtggtttaggttggagtgtagtggcgtaatttcggtttattgtaagttttattttttgggtttacgttatttttttgttttagtttttcgagtagttgggattataggcgtttattattacgttcggttaattttttgtatttttagtagagatagggttttatcgtgttagttaggatggtttcgattttttgatttcgtgattcgtttgtttcggttttttaaagtgttgggattataggcgtgagttattgcgtttggcgatatttttaaatttttattttgatttttgttagttattatttatattttttaaaggtaagttgtagtttgatgatttattttgtttgtttttgatttttatataggtggagttaagtatttattattatgtattgttttgtatgatattttttatttagtattgtttgtgagttattatgtttttaggatagtagtagtagtttattgattttttagtgtcgaatgttaatttattatgagtatgttgtggtttgtttttttattttaatattgatagatttggttattataaatagtgtttttgtgtatatttttggaagtgtattttgattatatgtatttatttgttttggatgtttcgaaataattgttggattaaaaagtatgtttggttttgggagataaaaattttataaagtagttgtatttttgttagaagagaataggttttagttagtttatatttatattaatattggtattgttaggattttttaggtttttattgtaatttttagtatgtatttttttatgattaatgacgttgagaatttttttatgtgtttgttggttatttggttgtttttttttgcgaagtgtttattttttagttattttaattgtaaggtttgttttgttttatttatttataggagttttgtatgtaatttggaaggttcgattttgtttttatggttaaatattttttgattatttttatttttattttttgtgggtagtgaaatattgtggtatttttttggatttttttttttttgtaaaattaagtttagtatagaaatttttttttttgttgaagtatttttgttcgtgaatattttgtagaatttttatatattatttagtatattttatgttgttgtgagtttgtgtatatgtatttatttgttttttgtattataggttaaattatgtttttttggattttttgtaaagtaaaagtttgatttgatatggttgatttaaaaatttggtgtaggttgttttagtaatgtggatggagaagtatataggagtttattattgattatttggatgtggagaagtgatagttatatgtgttttataggaaagatggtgtgggttttatttatatatagttttgtttagaaagggtaagagatggtttgtagggatatataaaaaataaggttatgtaaattagaagtaggtgggaatgtttatagtaattttttttattttaaaatttttaggtaagtaaaatatttttacgtttataggttggttgtttgttatattgtttgttattattataagaggggaatgttaatggtttatcgtattttataaagtattttttgaaatatatttttaggtaaattagttttagtattaattagtttatttggggaatttaaatatatttattagaaagttatttttttttgtaga

SEQ ID NO: 210 - DNA, 11812 bp, Artificial Sequence
  chemically treated genomic DNA (Homo sapiens)
tttgtaaaagaagataattttttaatgaatatatttaagttttttaaataaattgattaatattaaaattaatttatttggaaatatattttaagaaatattttataaaatacgataaattattaatattttttttttgtaataatggtaagtaatatggtaagtaattaatttatagacgtaaaagtattttatttatttaaaaattttaaaatgaagagaattattgtagatatttttatttatttttgatttatatgattttattttttatgtgtttttataaattattttttattttttttaggtaaggttgtgtataaataaaatttatattattttttttgtaaagtatatatagttgttatttttttatatttaggtaattagtaataaatttttatatgtttttttatttatattgttgaaataatttgtattaagtttttaagttaattatgttagattaggtttttgttttgtaaaggatttaaaaaagtataatttaatttatagtatagggagtaaatagatatatatatataaatttataataatatgaagtgtattgagtaatatgtaaagattttataaaatatttacggatagaaatgttttagtaaaagaaaagatttttgtattgaatttaattttgtaaggaaagaaaaatttaagaaaatgttataatattttattgtttataaaaaataaagatgaaggtggttaaagggtatttagttatgagagtaaaatcgaattttttaaattatatgtagaatttttataaatgagtaagataagatagattttgtaattgaaatggttaaaagataggtatttcgtaaaagaagataattaaatggttaatagatatatgaaaaggtttttaacgttattaattataaggaaatgtatattaaaaattataataaaaatttaaaaaattttgataatattagtgttggtgtggatgtagattaattggaatttatttttttttggtaggaatataattattttgtaagatttttattttttaaagttaaatatattttttgatttagtaattgtttcgaggtatttaaaataaatgggtgtatatagttaaagtgtatttttaaaaatgtatataggagtattatttgtaatagttaagtttattaatgttaaaatgagaaaataaattatagtatatttataatagattaatattcggtattgaaaaattaatgaattattattgttattttaaaaatatgatgatttataaataatgttgagtgaaagatgttatataaagtagtatatggtggtaaatgtttaattttatttatataaaaattaaaaataggtaaaatgaattattagattatagtttatttttagggggtgtgagtagtgattaataggggttaagatgaaggtttaaggatgtcgttaggcgtagtggtttacgtttgtaattttagtattttgggaggtcgaggtaggcggattacgaggttaggagatcgagattattttggttaatacggtgaaattttgtttttattaaaaatataaaaaattagtcgggcgtggtggtgggcgtttgtagttttagttattcgggaggttgaggtaggagaatgacgtgaatttaggaggtggaatttgtagtgagtcgagattgcgttattgtattttagtttgggttatagagtaagattttgttttaaaaaaaaagaaaaaaaaaaaaaaaaaaaaaaggatgtttgtaatgttttatttattaatttgagtggtggttatataaatgtattcgttatttattttgaaaaaaatatgtattattgattagtatatttatatttgtgtatttgtatgaatgaacgttatatttgataaaaaatttatttaaaaaattttaattttttattattttgttttatagaaatattaattttaaataaaaatatttttttttaagtacgttatttttttttattttattagtaatttttaatttgttacgtttttttttataatagatttaatagttttgtttttttattattaggtgttattgttttgtttttaaatttatatatgttttttaattttgttttataagtagaaagtaaatattttagattttgtattaagaagtaataattgaaaatattatataagtatttatatgaaaaacgagaattaaatttttataattttttaaaaattttgaaatagaaataataatagtaaaagtttttgtaatataggtttattaataagaatagaatgtttttttaagagaaattattttatttaattggggtataaagttaatattttataattgttaatgtttgtaaatgtttttttgttataaattatttttagttttaaaattatataaaaataggttgttatttgatttttaggttatagtttgttgattcgtcgtttattaattttttgaaaatatattattttttaatagattaagaatttttttttgttgtttttttttttgttgttatttaatataaatataatgttatattgatgattttttaaaagtttgagttttaaaatttttttattttttaaattatgataatttttattatgtattttatttttaagaattttaatttaaaattgataattttttatttttaagaattttaatttaaaattgataattttttttattattattattaaaatttttattattttagattttttgttttttttaatttttgtaatattttttttgatgttattttttgttttagtttggatattatttttagttattttaaagattttttttttagttttattattgatttttttaaattaatttttttaattatatataatttagtgttaattattaattttggaaaaaaagttatttattttttaggttttggttaaggatgattataaaatgttttaaaattagggaataatgttattcgattatatttgtgtttttttaaatggtatttatatataagtttatttttaaatatgtttatattatttttatagttttttatcgtttttcgttttgagaatgattttattattagttttaaggtatgatttttaattttagttgggttttttatatttaattaatttttgtatttttttttgattagttttttagtaattatttttagtttttattttattttttaaaatttttattgttttttttttttattttatattaatatagaatgggttagttttttaaaataaaaaatatttagagttaagggtggtggtttatgtttgtaattttagtattttgcgaggttaaggtggtagattatttgagtttaggagtttgagattagtttgggtaatatggtgaaattttatttttataaaaaatataaaaaaaattagtcggatatggtggcgtatatttgtagttttagttatttttggggttgaggtgggagaattgtttgagtttagaaagttagggttgtaatgagttaagattgtgttattgtattttagtttaggtgataaagcgagattttgttttaaaatataaaatattaaggagtatttattttgttttagaagagcgtagtgttttatatgtattattttatgtaatttttttaattcgatgagattggtggtagtattaatattttatttatgagaaaaggttaagagggtaaaagaatttgttttgattgtatagaggtattaaatgatcgagttatgaaaggtttaatttagagtttagggttttaaatattttattatttggttttttgttttatatgaaaataaagaagagtgagaaataagtatgtatttatttaattatttattaaataattataaaaagtttttatgttagatttatattatgtgttgagagtataaggaagtttttgtttttatgaagtttatattttttaatgtattataaatatatgaaattgttttttttttggtgtaatgtaatagtttttttttatttatgagttaaatgttttaagattttttagcggttgttgtttgaaattgtagatagttttaattttatatttattgttttttttttatatatgtatatttatgataaagtttaatttataaattgggaataagagatgaataataataaaatagaataattaagttagtatatatagtgtggatatattggataaaaggatgatttatgttttagttttaagtaagagagcgagatagattttattttattatttagaagggcgaataatttaaaatttacgaattgttaatttttggaattttttatttaatatttttggattatgagtaattggaattgtagaaattgaaattgttaagggggtgtggggggggggggttgttgtatttttatatagtaggattattgattttattttaattattttgtttttaagatttaaagttttatttttttaaagttttttttgtttattgaagataataaaattttaattttgatagtattttattagtatttattttttcgatatttatttttattttatattaaaaatatttaattttaaaggataggtaagttgtttagtggtgagatgtttgggttttattttggattttttagttatatggttttatataattaatttttggacgataagggtttgaattatataggtttacgtatatataatttttttttaataaaagttatattaagtgtgtttgttttttttgattttttatttattttttttattttttttatttttgttatttttgaaatagtaagattaatttttttttttattttttttttttagtttatttaatatgaagataatgaagatttttatgatgatgtatttttatttattaaaaagtaaatgtatttttttttttttataatttaagattattttattttttttagtttattttattgtaataatatagtatagaatatatataatataggattgtttatgtttttagtaagtttttttgttagtattaggatatattaagttttgggggagttaaaatttataacggatttttgattgcgagagtttagcgtttttaatttttgtattgtttaagagttaaatgtatttagtaattgttaattaaatattttagtatttgttttttttttggtgtattatagttattttattaatattttttttaaagaggtgggtattgggtagttttttttattgatttttaattgtttgtagtttatagttttcgtttagttttatgaaaatttaatttatatttatatattttttttttttttttgtgtgttataaaaaaaatgaaattataaagaatataaaaatatataaagtttagttagtttagaagtatttttataagtagttggtaaaggtttttaaaatatagtatttttattagattttttgtttttatttttttagaaaagaaaataatgtagatgcgaatgttttatttaaggtttaaaatataggtgtaaaaagaagaattaaagtaaaaatatattaagagaaagttttatatgataagatatttttggatatttattgaaaatgattttagtcgttatttaacgttaataattttagagttgtttatgtttagaaaaggtgtatatgaatatgaggattatatttgtttaacgagttataatatttggacgttggtttttgggacgtttttgttttattgttttttgttttttgttatataaaatttattttttaaatttagagttttttaagtagatttatattgtagtttgtttttagaaatagaatttatttatttttttgaaaaaattcgaatttttttattattgtaaattattttgtattattaaaatgtattaattttttaataaatttacggtataattaatgttaatttttttttagttaaaatttttaagtttaataaaatttttaggattgatatatgttttaaaatgaagttttagaattatatatttatttatgatattttgagtagataattgaatattaacgattaatttaaattatatgaagttagtataatatatttattggaaaatatatttaaagattggagggattttttttgggggggggggcgggggagcgtcgtttttatttgacgaaatatgttgttttagaaagttttatttaattaagataagaaaacgtaaagaatttataattttatggaaattaaagcgttagatatttattttaagtgtaagagaattattttaaaagattcgatatgtaaaaatttatagttaagtttaggttttttatagtttttaaaagaaaaattaaaagttttaatagtattttaggttgtttttataagttagtttgtgaagttttaacgttttttagcgaaattagcgaatcgttaattttcgagaagaaatgatgcgaaaatttttttcgtattgatattttagtaagtgaaagagatttttttttttttttcgtaattttttttttttttattgtcgaatagtgcggtgttttttaattgagacgacgttaaattattagaagatttttagtgttcgtttaggaattaaattcgcgatcgtttcgtacgtgttaggtttaggattatagatattatttttcggttttgtttagtattttattcgtttttacgttttttttgcgtttaaagatttttttattttttttatagagagaaatttaagaagcggaaagattagatgtcgatttaaaaagtgcgcgatgcgagtagttaagtcgtatttcgttattttgttaaagaaaagggagtttgtgtttattaaaattttattggtagcgtcgataaacgaatagatagattttgtattgcgtatgtgttgtggtaaaattggtttaaagaaaggggcggggtttattttggagagtagaggataacgacgtatgcgcgcgggttgttttattttttgcgttagggcgcgagtgacggaaatagatttttttatttgtaggtttgtcggtattttttttttaatgttggttttcgattattagttagtggtttgtagtttatttcgttaataattattgaaagtttagaattgattgttgaggtaatgtgattgtattgggatgcggtaaaggataatatgaggaggtttttgttttttaggaagttatatatagggaagaatatttaggtttttttatttggtatacgttaattattttgtaagcgattgttaaagtgagggtgggtttttagatagaaaataagtgaaataaattttagatatagtaagagttataatttggtggagatggttgggttggatttatttaattaggatggttagagaaaatttagataggaattaaggaaattagagaaaagtttgatagagtaataagttagttgagagttgtggtaagagaaggaggtgattaaaattagagttagggtaaaaatatgattgttggaacgtatagtaaaaataatgattatgagataggaagggatttagtgtgtgcgttttaaaaattgaatggtttgtgtgtattggggagtaaggttaaagagtttgataagggttaggttatgattatggtaaggaatatggggtttttttttaagtattttgtagtgttttttgttagttattttttattttttaggtttttttattttgaagagttttagggattttggattttttttttatttagattaatgttttaaatggtaacgttttttgtatgtagtttgtatattgataatttttaaattatagtcgtaaaattgattattagttttagatttaaatgtatttagtattttaacgtgagtttgttttaaattaagtttttttatgtagtttattaaatttgttttagttgtattttttatttcggtgaatggttattttatttgtatagttttttagatttaaaattttagagttattattgatttttttttttatattgtgtatgaaatttattaaaaaattttttaattttaatttttacggtatatttagatttaattagtttatattattttcgaagttttaattttagtgtatattattattattttttgttttgattttgggaattatttcgttattaattattttgtttttttttttttttttgtgttttattttttataaagtagttagagtgaagttttaaaagttaaattatgtttaaaggtttttaaggtttgttattttatttagagtaaaagatgtagtaggtattataagtgatttaataagttagtagattatttggatttattatttttttgattttattttttaaatgttttttttttgtttatttgattttaattatatagatttttttttagttttttagttatttttattttgtttttattttgttttgttatatttgttattatttttattcggaatgttttttttttagttatttgtatagttttttttttgttttttttatattttgtttaaatgttatttgtttaatgagattttttttgattagtttatttaaaaatgtaattaatttgtttataagaattttttattttgtttttttgttttattttttttgttttatagtattttatttattttatttatttttggttttttttgattattgtattaattttataagattagggattttgttattattttaaatataataattgtttttcgaaagtttaaataatgtttagtatatagttggtatttaataaatatttttgaatgtgtatatgagtaaaagaaggaggtaggtttttggagagtgatgtaaagtttatttatttatttattttgagacggaattttttttcgttgttaggttggagtgtagtggtgcgatttcgcgttattgtaatttttgtttgtcgggtttacgcgatttttttgttttagatttttgagtagttgggattataggtacgtgtttagttaatttttgtatttttagtatagacggggttttattatgttggttaggatagttttgattttttgattttatgattcgttcgttttaattttttaaagtgttaggattataggtgtgagttattgtatttggtttgatgtaaagatttttagttgaaatgtattttaattattgtgtggtaaatgaattgtgaaggggtaggaatgaaggtagtaggattagtttgatgtttttagattgggcgagggttaatggtggtatagataagtatatttatataagtagcgagaagagataagatttaagatggattttggtggtagaattaataagatttgtttttggattggatatgatggataaggaagagtaaaaattaaaatgatttttagaaatattatttagttaaaaaggaggggattagttatatatataataattttaatgaatttttagggaattacgttgagtgaataaaagttattttttagtcgggcgcggtggtttatgtttgaaattttagtattttgggaggttaaggtaggtggattgtttgaggttaggagatcgagtttagtttggttaatatggtgaaatttcgtttgtattaaaaatataaaaaaattaatagggtatgttggcgtgtatttgtaattttaggtatttaggaggttgaggtaggggaattgtttgagttagggaggtggaggttgtagtgagttgagattttattattgtattttagtttgggtaataaagtaagattttattttaaaaaaaaaaagttagtttttaaatgttatatattaaattattttatttatataatatttttatatgataaaattatggaaatggaaattagattagtaattgttaagggttaaggaggatgtgggggtgggagggaagtaagggtggttataaaaggtaatagtagggatttttgtggtaatggaatgtttaggattttaattatgttattattttagttgtgttattgtattgtaatttatgttttgtttttaatagttttattgagataaaatttatatattaaatagtttatttatttaaagtatatagttttatagatatatatagataagtgtagttattattatagttaattgtagaatatttttattattttaaaaagaagttttgtattttttagttaagggtaatttttttatttttttattttttttattttagttttaaataattattttttatcggtataggtttttttatttaagatgtttatatgaatggaatcgtataatatgtggtttttggtgttttattttttttattttatatgatgattttaagatttatttaagttgtagtaggtattagtattttatttttttttatggttattgtatttatataatattttattgtagttatagattatttattgtttacgtatttatttgtaaatggaaatttatatagtttttattttttggttattaaggataatgttattatagtaattttagtattttgggaggttgaggtgggggtattatttgaatttaggagtttaagattagtttggttaatatggtaaaattttatttttattaaaaatataaaaattagttaggcgtagtggtatgcgtttataattttagttatttgggaggttgaggtaggagaattatttgaattcgggaggtggaggttgtagtgagttgagatcgtattattgtattttagtttgggtgatagagcgagattttgttttaaaataataataataataataataataataatagtaatgttattataaatattcgtgtataagtatttttgtggatatgtgtttttaatttgtttaggtatatgtataggagtggaattgttgggttatatttttgtttaatagtttgaggatgtgttagattgtattatagttttgtaagatgttattattagggtgaattgggtagagagtaaataggattttttttgtgtttataagttgattttataattgtatgtgaattttttattttaaaattaagaagtttatttttgtattttgggtttaagaaattgagttttttttggtgattagtatatggggtagaatggtaaaggaatatgtatgggtatttaaataaggagttttgttttaggtaaaatgagatttttattaaatatttgagtggttatgtttagtaagtaaatggagatattattttggatgagttgatatagttatcgattgtttataatgtatgttattttgtatgtttttaatgatgtggaagtattatatgatttttattattatgttatttatagtattgttgggaaagtaaggatgaatgtttatgaagtagagaatatatgttagtataagttgttaaattgtggggtatagtttgtgtggtttttaagagttgagaaataatagttgtaatttgaagttttttgaaattttaggaagttgtaataaaatataaataggaaaagaggtagaagtgaggtagagtataggaagtaaggaagtaggtagtagtatgaaaattttttaaaaaggaatagagagtatttttgagaagtagagagaaataagatgtaattttatttgataaatattttgaatttttattatatgtaaggtattaagttaggtgttattgggaatatataattaataagtgttagttcgtggttataggagtttttagttttatagatgataattattaatttatttaatttaaattaaatgtttataatatgttaggtattattttaggtttagggaatatagaaggaaagaaaataatattttttaaagaaaatttata

SEQ ID NO: 211 - DNA, 8996 bp, Artificial Sequence
  chemically treated genomic DNA (Homo sapiens)
atattataaaaatttaaaaagtaatgtgagtggatttatttttatttaaaaaataatatattttgtaaaagtgataattttagtaataatatattattgttttaataattttgtattattttgggtatttataattggttttcggtttatttttaaatttacgtattgtttttgtttttaatttttaaaatataattaaaaatatttgaattcggaatatttacgttttaagattttttttttatttttgtattttaaagaaatgagtattttatataaaagtaaatatcgagagataatcgttgaatatgatatattatttttttaagtaaataattatttttttaataattttttcgtttttaaattttgtgaagttaagcgtaaattatgtaaagtttattagtaatgataaaaatagcgtgttaattggggtaggggtagtaagaaaataatagatttatatataaagtttatttttatttgttgtaattaatcgtaattattttaaagtttttttttatttttatttcgagtattttaataaattagtaagtgtattagtttgagttcgttttaattgaaatatttaattattagaacggttgatagatattataggatattaggtttcgaataattttattaatagatttagatttttaagcggtttgaagttcgtaataataaagaggatttaagattaattaagaaacggtcgttagagatttttttcggttataggtatcggtcggtaaaattcgcggaggcgagagggggaggggatacgcggcggcggaggaggagttgaggaaggaattaggttcgtttttggcggataatcgggtttacgagtagttaaacggtaggggggatttaaataggggagaagggtgaatattttaattcggttttgaaatagggagttttgggttatttcggaaaaggcgaagtttttcgagggaaaaggaagggagcggttgggggggcggttggggggggttcggaaaatggattttaggtttaggcggggttttagcggggtttgagtcggggaacgattgcgttttcgaagaaaggtgttaaagaaggttaggtgagggtttaacggttcgttgggagtagaagaatttgggaggcgtttatttggaaagtttttgttgaatttttcggaatttattgattacgaaagatttaaaaatttgttcgatgttggtcgttatggcgttcgtttcgtttttttaattttttttcgttagttttttaggtttttagtatgtttcgggaggaggcgtacgggttaattcggtttttcgtttttttgattggttttaaagggaatgttcggttcggttcgttttatcgagggattaattagtgagtacggttttgtttttttttgttgtttttgagcggttggggtagaggtgttgacgtttgcgtcgcgtacgattatgttcgttatgttagtgtttgacgtaggcgttattataggagtcgttttttttgaggcgatcgtgttcgtataagttgttagtttttagtagtgtttgggagttttaataggtttgttaagtgtttgagattaaaggcgaagaggaagaagagtaagaagggtaattcggtgtttaatatacggtttttaggcgtttttaggtggcgttaagtttagtttcgatagggatatgtattcgggagagaattttttagttttcgtttttattggtatgtgagaggaggaattcgttgttgttttgtgttttttttagtgcgttttataattagttttatttttttttttagtaataggtcggatgttttaagcgatcggtatttaaagttcggtgtattttagttttattaggagttaggcgtgttacgagattttttcgcggtagttgtttagttttgattcgtgagcggcgtataattggttaagaatgggtttagtattttggcgttttttttcggcgtttttggaaatattgcgtggtatttcgtattattgttatattataaacgtgttaaggtttgggtgtttcggttggggagtagttaggtagcgtttagggcgggagggaattagattagattttcgtcgcggagatttagggtcgcgcggattaatggggtagggaagtcgtcgtagggcggggtagtgaggggcggtgtcgcgttggtttcgcgtcggtttcggtgggtcgattttcggcgagcgggtaagcgggaattaggtggttattcggtgtcggtgcgtaaatttttttcgtttttatacggagcgcgtttaggttttggtttggggatttaagatcgcgaattgagtgaaattatagaaattgatttgtagaaatttttttgttgtttgtaaatgcggtgggtgggggttggttatgtgttttttatttgttattgttagttggtttttatttgtttttttattttttttgttttttaagatgttaaggtttttttgtgtttttatatatttttaggatataattttaaattggtgtattttttttttatgtattcgttgtttttggtagattatttggttaattttgtagttggtttttattttattttttatattttttgatacggttttatttgtttgttttattttgtttatgttatttattttgaggaatgaggtttaaggttagtgaagttttttaaggtttttttgttagtatggggtagcgtttttatttaggttaaggcgttgtgtgagatttaggagtttaggcgtttttattattgggtagtaaggttatttttagtgatttattagagtaaatagaatttttttatattattgttatatttaaattaaagatgtaatatttgttttagatttaaagatttgtttatttttggtcggatgtgatgtaattttagtatttgggaggttaaggtgggttgattattggaggttaggagttcgagattagtttggttaacgtagtgaaatttcgtcgttattaaaaatataaaaattcgtttggcgtggcggcgtacgttcgtaattttagttatttgggaggttgtgaggtaagagaatcgtttgaattcgggaggcggaggttgtagtgagttgagattatattattgttttttagtttgggcgatagagagagattgtttaaataaataaataaataaataaaataaaaaatttgtttattttagatatatatggtaagtaaaatgtgttttttcgttatattaaagtagttgtttttttcgagattgtaatttaatagggtttttttttttttttttttaaatttttaatgattatcgttttatttgttgagagaatttgaagtaaaattgtttttgttaggttttatttttttttatttgtgtgatttttagtaagttatttatttatttgggtttttttgttttatttgtaaattggtgatagtaatagtattttttttataggatttttttatgataagtattttaaatagtattttgtttaaggttaagtgtttaaaaaaatgttagttttgtatattgttagtttatattttttttaaaatatgtaattttaatattattaaaataagtttttaatttttttttttttgttattagtttgttttgtggtaagtaaatgtaataagttaatatttattattgttgagtgttagattgtatttatttataaatgttattttagttaattttttaggttatattgttgttgtatttatttttttaagttttaggtgttagaattaaagtgaaatgagttggaatttgatttttgttttttttattaatattttagtatattgcgttatttgaattaggagttagtaaattatggtttatatattaaatttttttgttgtttgtttttgtatagtttattaaatatgaatgattgagaaaaagaataggaaataaatgaggtttttgtgatatgtgaaaattttatgaaatttaaattatagtattcgtatataaagttttattgaaagcgagttacgtttatttgttataaatttttgatggttttttgttatttaaagtattgataggtaatagtgatttttgatttattgtttgtttatgggtttattaaatttttttggatattggtatattgatttattttcgtattatttttggttgtttttttgttaaggtggtcgagtcgagtagttttgatagaattatgtggttttttttgtgtaaagtttgtttattttagtttttagtatattttttaatttatgataatttaattatttgtaagattttaaggtttaaaaattgatattttataatatattttgagtttaaaataagatttattttataattaaggtatgatgattattaaatttttttgaagtgaagtttagagaagggagattattatataaggagttgagagttatcgtttgattttttaatttagttttttaggttagtttgttttttttttgaaatattttttttatgtttatgacgatagttatattttttaaattatgaattttagttttttaaaaatgaattattggatgaaaatgttatttgtatgagtataaatgattatttaaattatatttataaatttggattttttttttttttttgagatggttttgttttgttttttaggttagagtgtagtgacgtgattttggtttattgcgatttttttttattaggtttaagtaatttttttgttttggttttttgagtatttgggattataggtattcgttattatgtttggttaatttttgtattttagtagagatgaggttttgttatgttggttaaggttggttttaaatttttgattttaagtgatttatttgtttcggttttttaaaatgttgggggtataggtatgagttattgtgttcgtttttgggtttttaaaatgtgtattttaagatataaattgtggttttttttttgtaggttttatttttttttggaatttttgttttatagatagaataatggtagttcgagtatttataattggtagtggaggaagggaatatacgttggtttggaaatttgtatagttttattatgttaaataagtgttggttgttttaggaaacgtaggtattgtttgttttgaaaagattttaaatatcggtaattatgttttaaagtggggagtaatagttattatttgttattaatggtatgttgttaattatatttgtattttatgttaataaagataggttgggtatagtggttaatgtttgtaattttagtattttgggaggtcgagatatgcggattatgaggttaggagatggagattattttggttaatatggtgaaatttcgtttttattaaaaatataaaaaattagtcgggcgtggtggcgggtgtttgtagttttagttattcgggaggttgaggtaggagaatggtttgaatttagggggtggagtttgtagtaagttgatattatgttattgtattttagtttgggcgatagaatgagattttattttaaaataaaataaaatatagattattatttagggttgagtgttttttttgattttaaaatttatttggtaatttgaatgtttgttaatatgttataaatttaaggtaatttattgtttagaatatggtatttttttattttaaattgttttaaatttgataaaatatatttattggaaaagtagtaagtgtttaatatagattaaaggtattttgttgtgtatttttgtaaatggaaagtttagtattgttattaaatataatttgcggttacgtgtagtggtttacgtttataattttagtattttgggaagttaaggtagaaggattttttgagtttagtagtttgagattagttagggtaatgtagtgagattcgatttttataaaaaaaaaatataaaaattagttaggtatggtggtgtatatttgtagtgttagttatttgggtaatagagtaagatgagaatttgttttataaaataaagtttttaatagttgttattttaatagattttaatttttatttttttttgattttttttttttttttttttttgagatagagttttatttttatttatattggagtgtagtagcgtgattttagtttattgtaatttttggtttttgagttaaagcgatttttttgttttagtttttcgagtagttggtattataggtgtatgtcgttatatttagttaattttttgtttttttagtagagatcgggttttattatgttggttaggttggttttaaatttttgattttaggtgatttgttcgttttagttttttaaagtgttgggattataggtatgagttatcgtgtttagtttttatttttattttttaattggtaaaaatgaaaaaatggttagtttatatattatattaagtttgttagtggttttagaaattttttagtattttaataatatttagaataaaatttaaattttttattatgttttttaaagttttttgtgtagtttgttttttgtttgtttttttagtttgattttttatatttttttttttttttttattatattttatttatgttgttttattaattttttaagtagaagtttgttgttttggattttatatttgtttttattttttattatgattgtttttttattatttagagttttatttaaatgttagtttttttaattatattttttttatagttttttattaaaagtaagtgtttatttttattttatttgtttatgattatgaatgtttgtgtttatttttattttattattgtttgttttttatgttttttttttttattagaatataatttttagtagaatgtaagttttatgagggtaaggaatttgtttgttttgttttgtatggtgtgtatagtgtttagttttttatgtggtatataatatttatggaaagaagagtatggatttaataagttataaattgggagaagatagtggtatgtatataagattaaaaggaataatataaattagtaaatatttttttttttgggattttaattttacgggtgagatatttgtttattagagaattaggatagtttatttgcgattgaggttatataggtaagtttattaaaattttttaagattattatgagattattataagtagttttgtaagattattaaagagattttttttttttgttgttttttgttatattgatatagttgacgttgtttagtttagttgtgtttagaattattaatttatagtgcgtggtattttattttaattatatttaggtagttgttgtagattgaggattttattttttttggatttggattttatatagtagttattagtttatttataattttattttttatagttttagttatttatagttagttgtagtttaaaatattaaatggaaaattttagaaataatttataaattttatattgtatattagtttagtatagtatgatgaaattttgtgtcgtttaatttgagacgtgaatttttttgtttagtatatttatgttgttatttattagttttgttggttattagattgattattatattattttagtgtatgtgtttaggtaattttgttttatttaataatggttttaaagttgatgttggtatatagttataattgttttattttagtattagtgatagttaattttttattgtgtttaatttgtaaattaaattttattataggtgtttatgtataggaaaaaatatattatatatatagcgtttagtattgtggttttaggtatttattagggattttagaatgtgttttttaaggataaagagggataattgtatattataaatattattttttgtattttgtattaatggtagagtgattgtatattttagttgatttaacgaatggtggtttaggtatagtgaagtaggagagtttttatggagttaaattatgtttagtatgtggttgattttattattagttatttagaattttatagaagaaaatttatttgatttgtaggttggagaagataggttttttttaaaagcgttattgagtttttaatttaaatagttttgttttaaagagattttttttgatttaatttaaaatagttttttaatttattttatattaaatttgtttaatttgtttatatttgttgtttttttgtttgtatgtttattatttagcgtttttatagcgtattgtaaatatgttaagtatagggattttgtttgtgttgataaatttttttttttttgagatagagtttcgtttttgttatttatttaggttggagtgtagtggtgcgattttggtttattgtaattttcgtttttttagtttaagcgatttttttgttttagttttttgagtagttgggattataggtgtatgtttttatatttagttattttttgtatttttagtagagacggggttttattatattgtttaggttggtttcgaatttttgattttaggtgatttatttatttcggttttttaaagtgttgggattataggcgtgagttatcgcgtttcgtcgtgttgatattttaatattagtgttgaggatagtatttagtatatagtggatttttagtataattgattgattgatattaaaagattaatttttgagtatattttacgttttttgtttaatatatagttaatattagtgacgtgaataatattatggaggtgatattttatggttttttgggaagtttattggtgtttttatttgtttataatgataacggagaattgagttttgttggttagtttaatgtatttttttttgaattttatatgttgaaattgttatttttgttaatataagaaaattaatagataataagtatattaaagtatagaatttagtttttttagtgagatatttagtttatttaagtggaatgtttttgtaaatgtagtggtttttttttttttttttttgtttatagt

SEQ ID NO: 212 - DNA, 8996 bp, Artificial Sequence
  chemically treated genomic DNA (Homo sapiens)
gttgtaaatagaaaaaaaaaaaaaaaaattattgtatttataaaaatattttatttaagtaaattaagtgttttattaaaaaaattaagttttatattttagtatgtttgttatttgttggtttttttatattggtagagatgatagttttaatatgtgaaatttagaggagagtgtattaggttaattaatagagtttagtttttcgttattattgtagatagatgaaaatattaataaattttttaaagagttataaagtattatttttatgatattgtttacgttattaatattgattgtatattaaataaaaaacgtaagatatatttagaaattggttttttaatgttaattaattaattgtattgaaaatttattatgtgttaagtattgtttttagtattggtattaagatgttaatacggcggggcgcggtggtttacgtttgtaattttagtattttgggaggtcgaggtgggtggattatttaaggttaggagttcgagattagtttgaataatatgatgaaatttcgtttttattaaaaatataaaaagtagttgggtgtgggggtatgtatttgtaattttaattatttaggaggttgagataggagaatcgtttgaattggggaggcggaggttgtagtgagttaagatcgtattattgtattttagtttgggtagataataagaacgaaattttgttttaaaaaaaaaaaaatttattaatataagtagggtttttatatttaatatgtttataatacgttgtaggaacgttgggtaataaatatataaataaaaaaatagtaaatatgaataaattaagtaaatttgatatgaagtgaattgagaggttattttgggttgggttaggagggatttttttggggtagagttgtttaagttaagaatttaatgacgtttttaagaggaatttgttttttttaatttgtaagttaggtaaatttttttttgtggagttttaagtaattagtggtaggattaattatatattgaatatggtttggttttataggggtttttttgttttattgtgtttggattattattcgttaagttagttgaagtgtgtaattattttgttattggtatagagtataagaagtgatatttgtgatgtatagttgtttttttttatttttagaggatatattttaagatttttagtggatgtttgaaattatagtgttgaacgttatatatatagtatgtttttttttatatataaatatttatgataaagtttaatttataaattaggtatagtaagagattaattattattaatattaaaatagaataattataattatatgttagtattagttttggggttattattaagtaaaatagggttatttgaatatatgtattgagataatatgatagttaatttgataattaatagggttagtaagtaataatatggatatgttggataaaaagatttacgttttaggttggacggtataaaattttattatgttatgttagattggtgtgtaatgtaaaatttatgaattatttttgaaattttttatttaatattttggattatagttgattgtgggtaattgaaattgtggaaagtaaaattgtggataggttggtgattattgtatagggtttaagtttagaaaaggtagggtttttaatttgtagtaattgtttgaatgtgattaggatggagtattacgtattgtgggttagtggttttgaatataattaggttgagtagcgttaattatattagtatagtagagggtaataagaggaagaggtttttttagtagttttataagattatttgtagtagttttatgatgattttaagagattttgatgggtttgtttgtatgattttaatcgtagataaattgttttagttttttaataaataaatattttattcgtagaattaagattttagaaaaggaggtatttgttaatttgtattattttttttggttttatatatatgttattatttttttttagtttgtggtttgttgggtttatgtttttttttttataaatattatgtgttatatagggaattaagtattgtgtatattatgtaaaataagatagataagttttttgtttttatggagtttatattttattagagattatattttagtggaggaaaagaatatagaagatagataatagtgaagtaaaaataaatatagatatttatgattataaataaatgaaatggggatggatatttgtttttagtaagaaattgtaggagagatataattaaggaggttaatatttaagtggagttttgaataatgaggagatagttatagtaaggggtgggaataaatataaagtttaaagtagtaagtttttgtttgggaaattggtaggatagtatggatagggtatagtgaaaagagaaaaagggatataaaagattaggttggaagagtaggtagaagatagattgtataaagggttttgaaaggtatggtaaggaatttgagttttattttgagtattattagaatattgaggagtttttgaagttattgataagtttaatgtagtatatgaattgattatttttttatttttgttaattgagagataagggtggaggttgggtacggtggtttatgtttgtaattttagtattttgggaggttgaggcgggtagattatttgaggttaggagtttgagattagtttgattaatatagtgaaattcggtttttattaaaaaaataaaaaattagttgggtgtggcggtatgtatttgtagtattagttattcgggaggttgaggtagaagaatcgttttaatttaggagttagaggttgtagtgagttgagattacgttattgtattttagtatgggtgagagtgagattttgttttaaaaaaaaaaaaaaaaaaaaagttagagagagataagggttgagatttattagagtaataattgttaaaaattttgttttgtgagataggtttttattttattttgttgtttaagtagttggtattatagatgtgtattattatgtttggttaatttttgtattttttttttgtagagatcgggttttattatattgttttggttagttttaaattgttgggtttaagagatttttttgttttggttttttaaagtgttgggattgtaagcgtgagttattgtacgtggtcgtaagttgtatttaatagtaatattaaattttttatttataaaaatatataataaaatgtttttaatttgtattaggtatttattatttttttaatggatgtgttttattaggtttaaaatagtttaagataaggaaatgttatattttgaataataggttattttaagtttataatatattggtaagtatttaaattattaaataaattttaaggttaaggaaagtatttaattttgaatagtagtttatattttattttattttgagatggagttttattttgtcgtttaggttggagtgtagtggtatgatgttagtttattataagttttattttttgggtttaagttatttttttgttttagtttttcgagtagttgggattataggtattcgttattacgttcggttaattttttgtatttttagtaaagacggggttttattatgttagttaggatggtttttattttttgattttatgattcgtatatttcggttttttaaagtgttgggattataggtattagttattgtgtttagtttatttttattaatataaagtatagatatggttgatagtatattattaataataaataataattattattttttattttaaaatatgattatcggtatttgaaatttttttagagtaggtagtgtttgcgttttttggggtaattaatatttgtttgatatgatgagattgtgtaagtttttaggttagcgtatgttttttttttttattgttaattataagtattcgggttgttattgttttgtttgtaaagtagaaattttaaaggaaaatgaaatttgtagaaagaaaattatagtttatattttaggatgtatattttagaaatttagggacgggtatagtggtttatgtttgtatttttagtattttgggaggtcgaggtaggtggattatttgaggttaggagtttgagattagttttggttaatatggtaaaattttatttttattaaaatataaaaattagttaggtatggtggcgggtgtttgtaattttaggtatttaggaggttaaggtaggagaattgtttgaatttggtaggaggagatcgtagtgagttaggattacgttattatattttagtttgggaaatagagtaagattattttaaaaaaaaaaaagaaatttagatttgtaaatataatttaagtaattatttgtatttatataaatgatatttttatttaatgatttatttttgaaaaattgggatttataatttgagaaatatgattgtcgttataagtataagggaggtattttaaaaagaaggtaggttggtttagagagttaggttaaggagttaaacgatgatttttagttttttatgtgataattttttttttttgggttttattttaaaaagatttaataattattatgttttagttatgaaatgaattttgttttagatttaaaatgtattataaaatattaatttttaaattttgaaattttatagataattaggttattataaattaaaggatatattgaaaattggggtaagtaaattttatataaaaagggttatatagttttgttaaaattattcgattcggttattttagtaggaaagtaattaaagataatacgaagatgaattaatgtgttaatgtttagaaaaatttaatggatttataaataggtagtgggttagagattattgttgtttattagtattttaagtagtaggaaattattaaaggtttgtaataaataaacgtgattcgtttttaataaaattttatgtacggatattataatttgaattttataaaatttttatatgttataaaaattttatttattttttgtttttttttttaattatttatatttggtgagttgtataaaagtaggtagtagaaggatttggtatgtgggttatagtttgttgatttttaatttaaatagcgtaatatgttagaatattggtagagaaggtaaaaattaaattttaatttattttattttagttttggtatttgagatttagaaggatggatataatagtagtgtaatttaggagattaattgaaatgatatttataaataagtataatttggtatttagtagtagtaaatgttaatttgttatatttatttattataagataaattggtaataggaaaaagaaaattgaaaatttattttgatgatgttgggattatatattttaagaaaaatgtaagttgataatatataaaattaatatttttttgagtatttaattttgggtagggtattatttaaaatgtttgttatgaaagaattttatgagggagatattattattattattaatttgtagataagataaggaggtttagataggtaaataatttgttggaggttatataggtaagagggggtggagtttaatagaagtaattttgttttagatttttttaataagtgaaacgatgattattgaaaatttgagaaaggaaaaaaaaaaattttgttaaattatagtttcggaaggaatagttattttagtgtaacgggaaaatatattttatttgttatgtgtatttgaaataaatagattttttattttatttatttatttatttgtttagatagtttttttttgtcgtttaggttggagggtagtggtgtgattttagtttattataattttcgtttttcgggtttaagcgatttttttgttttatagttttttaagtagttgggattacgggcgtgcgtcgttacgttaggcgaatttttgtatttttagtagcgacggggttttattacgttggttaggttggtttcgaatttttgatttttaatggttaatttattttggttttttaagtgttgggattatattatattcggttagaaataaatagatttttaaatttagagtaaatgttatatttttagtttgaatatagtagtagtgtgggaaaattttgtttattttagtggattattgaaaatagttttattatttagtggtgaggacgtttgggtttttgagttttatatagcgttttggtttgggtagagacgttgttttatattagtaggaagattttgggggattttattaattttgggttttattttttagaatgggtaatataagtagaataagataggtaaataaagtcgtattagaggatatggagaataaagtagaaattaattataaaattaattaagtaatttgttagagataacgggtgtataaagagaaagtatattaatttagggttatgttttaaaaatgtataaagatataaaaaggttttgatattttagaaaataggaaaagtaaaagagtaaatagaaattagttaatagtagtaagtgaaaagtatatggttaatttttatttatcgtatttataaataataggaaaatttttataaattagtttttatggttttatttagttcgcgattttaaatttttaaattaaagtttaagcgcgtttcgtgtaaaagcggagggggtttacgtatcgatatcgggtggttatttggttttcgtttgttcgttcgtcggaagtcggtttatcgggatcggcgcgggattagcgcggtatcgttttttattgtttcgttttacgacggtttttttgttttattggttcgcgcggttttgggttttcgcggcgagaatttagtttgattttttttcgttttgggcgttgtttgattgttttttagtcgagatatttaagttttagtacgtttataatgtgatagtggtacggggtgttacgtagtgtttttaggagcgtcgggggggagcgttaaaatgttaaatttatttttagttaattgtgcgtcgtttacgagttagagttgagtagttatcgcggaaaaatttcgtgatacgtttgatttttgatgagattaaaatgtatcgggttttgaatgtcggtcgtttaggatattcggtttattgttaaaaaaaaaaatgaggttggttatagaacgtattggggaagatatagggtaatagcgagtttttttttttatatgttagtgggggcgggggttgaaaaattttttttcggatgtatatttttgtcgaaattgaatttggcgttatttgagagcgtttgaaagtcgtgtgttaaatatcgggttgttttttttgttttttttttttttcgtttttaattttaggtatttagtaagtttgttaaggtttttaaatattgttggggattgataatttatgcggatacggtcgttttaagagagacggtttttgtaatggcgtttgcgttagatattaatatggcggatatagtcgtgcgcggcgtaaacgttagtatttttattttagtcgtttagaaatagtagaggagagtagggtcgtgtttattgattggtttttcggtggagcgggtcggatcgggtattttttttggagttaattaggaaggcgagagatcgaattggttcgtgcgttttttttcgaggtatgttgggagtttggaggattagcgaggaggagttgagagaacggagcggacgttatggcgattaatatcgagtagatttttaggtttttcgtggttagtaaatttcgggaaatttaataggagttttttaggtaaacgttttttagatttttttgtttttaacggatcgttaggtttttatttagttttttttggtattttttttcggagacgtagtcgtttttcggtttaggtttcgttagggtttcgtttgggtttgggatttatttttcgggttttttttaatcgtttttttagtcgtttttttttttttttttcgaggaatttcgtttttttcgaggtaatttaagattttttgttttagaatcgagttaagatgtttattttttttttttgtttgggttttttttgtcgtttagttattcgtaggttcggttgttcgttagggacgggtttagttttttttttagtttttttttcgtcgtcgcgtattttttttttttttcgttttcgcggattttgtcggtcggtgtttatgatcggaaagggtttttaacggtcgttttttggttaattttaaattttttttattattgcgagttttagatcgtttgggggtttggatttattaataagattattcggggtttagtgttttgtagtatttgttagtcgttttgatagttaaatgttttaattaaaacgaatttaaattgatgtatttgttagtttgttaaaatattcgagataaagatggaaggggattttgaaatggttgcgattaattatagtaagtgaaagtggattttgtgtgtaggtttattatttttttgttatttttgttttagttgatacgttatttttgttattgttggtagattttatataatttgcgtttggttttataaaatttgaaggcgaagagattgttaaagaaatggttgtttatttaggaaaatagtgtgttatgtttagcggttgtttttcgatatttgtttttgtataagatatttatttttttaaagtatagaagtaggaaagagattttgaaacgtaagtgtttcgagtttaagtgtttttaattgtattttaaaagttgagagtaagagtagtacgtgaatttgaaaatgggtcgaaaattagttgtaagtgtttaaagtaatataggattattagggtaatgatgtattattgttagaattattatttttgtagaatgtgttgttttttaagtggaaatagatttatttatattgttttttaaatttttgtgatat

SEQ ID NO: 213 - DNA, 5183 bp, Artificial Sequence
  chemically treated genomic DNA (Homo sapiens)
tgtgtttagtttaataaagaggttttttaagtttagatagatgaggttttagtaagtgataagttattttgagttagtttaaatttttaggttaatatgtattaggaattgttgaatttgatagaggggtatacgagggtttattatattattttttttatttttttttttttgagatagcgtttgtttgttatttaggttggatggaatgtagtggtacgaatatggtttatagtagttttaattttttgggtttaagtaatttttttattttagtttttcgagtagttgggattataggtatttattattatatgtggttaatttaagtagatatgaggtttttttatgttgtttaggttgtttttaaatttttgaggttaagtgatttgtttgttttagttttttaaagtgaaaatttttgtatgtttgaaatgttttttaataaaggttttgttttgtttatttttagataaattacgttttagattgttgtaattaaaatagtttaatttttaggggtgtttttagagatgttgtggagatttaaagaattcgtgttgattttggtggtaatttatgagtattttgaaaggatagatgtgattagtggtaattagtacgggtttattaagttagagtatattaagatgaatttattttattatatatttaatttttaatttttaatttatttatttagagatttagttatgagataggttaatttttgtatttttgtggggaaaagtaagagagattagattgttattgtgtttgtatagaaagaagtagatataggagattttattttgttttgtattaagaaaaatttttttgttttgagattttgttaatttatgattttatttttaatttcgtgttttttgaaatatgtgttgtgttaaatttagggttaaatggattaagggttgtgtaaggtgtgttttgttaaatagatgtttgaaggtagtatgttcgttaagagttattattattttttaattttaagtatttagggatataaatattgcggaaggtcgtagggatttttgtttaggaaagttaggtattgtttaaggtttttttttatgtgatagtttgaaatatggtttcgtgggaagggaaagatttgatcgttttttagttcgatattcgtaaagggtttgtgttgaggaggattagtataagaggaaggaatgttttttgtagttgagataagaggaaggtatttgttttttgttcgtttttgggtaatggaatgtttcggtataaaattcgattgtacgttttatttattgagatagggaaaaatcgttttagggttggaggtgggatatgtaggtagtaatattgttttgtaaagtattgagatgtttatgtgtatatatatttaaaagtatagtatttaattttttattttgtttatgatgtaaagatttttgtttgtttgttgattttttttttattattgttttgtgattatgatatattttttttttagagaaatatttatgaatgattaataaatattaagggaatttagaggttggcgggattttttatatgttgaatgttggtttttcgagttttttttttatattttgtttttgtgttttttttttttttaagttttttattttattttacgagaaatatttataggtgtggaggggtaatttatttttttaattttttgagacggggttttattatgttgttaaggttggtttcgaatttttgggtttaagtgatttattagttttggttttttgaagtgttgaaattataggtgtgagttattatgttcggttttagtttattttaatttaaggttaggaatttgatttattagagaaacgtagtagataatatatttggattttagtaaattgtttggtagaattttatgatatttgtttgagaggtttatagtaaggtggaaagggttgttttgttttatataaatttaggggagaaagttttattttggagttaatagattgggtttgaattttggttttgtttttttttagttgtgtgtttggttgttattttatttttttgagttttaatttttttattagtaaaagtaatatttattttttagggttgttgggagggagaataagaatttttaaagtattcgaatttagtaattaggatattatatttgtaggtaagatgaagaggggtggggaagtaataggaaatagtttaaatcgagagttataatagtttttttttatttagtgttagtgtaggtttgtgattttgtttttaaaaacgtttggggtaagttgtaggaaagattcgagatagtttatgttttattataagtttaagggaggaggattttaggtagggagattatttatggtatttgttaaggagaaacgttattgattagagagaggtttagttatgtatttcgtgtttggtgaatttttgttttgatttcgttgtttttagaagtgtttaggtggaaattggaaggtttataagaggtaattcggtagtatatagtggtttacgtttgtaatttaaaatttaagtattttggaaggttaaagtaggaggattatttaagtttaggagtttaagattagtttaggtaacgtagtgagatttatttttattaaaaattttaaaatttgttaggtatggtggtgtgtatttgtagttttagttatttaggagagttagagaatcggcgtatttcggagttcgaggttgtagtgagttatgattacgttattgtattttagtttgggtgatagagtaagatattgttttaaaaatataaataaataaataaataaataaataggtcgtgcgtagtggtttacgattgtaattttaatattttagaaggcggaggttagcggattatttgaggttaggagttcgggattagtttgattaacgtggtgaaatttttaattttattaaaaatatataaattaggcgggcgtggtggtggtcgtttgtaattttagttattcggtaggttgtagtaggagaatggtttgaattcgggaggtagaggttgtagtgagttaaaatttttttattgtattttagtttgagattaaaaaaaagaggcgattttttatatcggtggaaatttgagttgtttaaattttggatgttttttttagttttaatattttagatttttttggtggataaatattttatttttttttttttgagtagagtttttgagttttggttcgttgggaatttgttatttttaaaaaagttcgaggttcggattgtttttttcggagttttgaggttgatgagacggagcgagagaggggtcggggtcgaatggagtttattcgcgggtttagggaggtcgttagagggcgttcgggatcgatcgtaagaataattttttttttttttcgttaatttttcggtagcgcgtcgtttagggtgggggtttcgagggttggggtcgtcggtttttttttggggatttttcgttttagagaaagttaagcgttaggcgtagttaaagtcgagaggtagcggaagttttcggttcggggtggcgttgggttagcgggtattttttcggcggttttttggtcggtcgaattcgcgtttggtgttttgttatttcgtttttcgttttgagtgagtttgtttttttttaggggcgcgttcgagtcgtttcgggttggttgcgttagtttagagttaaatttttagttaatgaaaaagggcgcgaggcgtgacgtacggaaacgttatgggaattttttttttcggggggtcgagaaggggttttttcggttttgagttttgttggtaggcgaggtgtcgcgatcggttttaggtgggtcgggcgcggagagaagtcgtaattagagtcgtcgttacggtgagtggttggatttagatttttgggtggtcgggataagagaaaagagggaggagggtttttagcggatagcgtttggggttggagagtagtagttgtatatagtcggaaagggcgcgtaggcgacgatattcggatttacgtcgatatcgttgtataaagatacgcggattcgtacgtatatttgtatttgtgttggcgtatatacggtagcgttcgtgtagtcgtattcgtatatatatgtatacggagacgtgtttatcggtgtattggtgtttgtatttatattttttacgtataaatttaagatacgtttattcgtgttcgtatattaagataggcgttgatatatatttatattgagaagttcgggatttatttatttatatatatgttcgtttgtatatttatgttgacgttatggatatataatatgtaattaagtattatagtcgaaatatatttgtggagttgtgatggagatatatttttgtattaggtgggggggggggggggggagcgtgtagagatttttttgtcgtttgcgcgtttagaatcggtgcggtgtgggattagttgttgttgtgaggtttgggagagagagaaaagagtttatttcgaggaggagatatttttttcgtagttttagaatcgcgttttcggggtagaatttcggggttttttataggaaagagttttcgtttataggttgttcgaaggggaggtcgttcgatagtaggaatgtttttttaaaagttttcggggtttattagtcgtggttttttttttggtagaaaattttaaggttgttttagatcgggggaggggagcgggaggcggatttggttttagattgttagttttttttcggtcgtgaaagatttttttgttttttgttttggagggaggagggggtttaatttttatcggggtttttcggatttttttagatttttgttcgttgaaaagtagcgggagttcgtagattgtcgagggtttttcgtttttttcgtcgcgagggcggggttagtggcgttatttttaggttcgtttttttcggtttcgtttttttttggtattttcgggatttttttaagttgttttaatttttttgtttttttttcggttaagtttaatttcggatttcgttttttatcggattttattcgttatattcggataggcggttggaggaggtcggatttttttttaaatttgggtttttatttttcgtttatttttatttagatttgatttttttttttacgttattttttttaattttagg

SEQ ID NO: 214 - DNA, 5183 bp, Artificial Sequence
  chemically treated genomic DNA (Homo sapiens)
tttaaagttgggaggagtggcgtgggggagggggttagatttaaatgggggtgggcgggagatgggggtttagatttgggggagggttcgattttttttagtcgtttgttcgggtgtggcgggtgagattcggtggagagcgagattcggagttgggtttggtcggggaaggggtaggaaagttagagtagtttaggaaagtttcgaaaatattaaggggaggcggggtcggagggggcgggtttggaaatgacgttattggtttcgttttcgcgacgggaggggcgggaggttttcgatagtttacgggttttcgttgttttttagcgggtagaggtttaggagaattcgggaagtttcggtgggggttaagtttttttttttttttagggtagggaataggagggttttttacggtcgggaggaggttggtagtttggggttaagttcgtttttcgtttttttttttcggtttggagtaattttgggattttttgttaggagggaggttacggttgataaatttcgggggtttttggggggatatttttgttgtcggacggtttttttttcgaatagtttgtaggcgggggtttttttttgtgggaggtttcggggttttgtttcgagaacgcgattttggggttgcgggaaaagtgtttttttttcggagtgggttttttttttttttttttaaattttataatagtagttggttttatatcgtatcggttttgggcgcgtaggcgatagggagatttttgtacgtttttttttttttttttttatttaatataagagtgtgtttttattatagttttataagtgtgtttcggttgtagtgtttggttgtatgttgtgtgtttatggcgttaatatgagtgtgtaagcgagtatgtgtgtagataggtgaatttcgagttttttagtgtgggtgtgtgttagcgtttgttttgatgtacggatacgggtgagcgtattttgagtttgtgcgtgaagggtgtgggtgtaggtattagtgtatcggtgggtacgttttcgtgtgtatgtgtgtgcgagtgcgattgtacggacgttgtcgtgtgtgcgttagtataggtataggtgtacgtacgggttcgcgtatttttgtataacggtgtcgacgtggattcgagtgtcgtcgtttgcgcgtttttttcggttgtgtgtagttgttgttttttagttttaggcgttgttcgttaaaggtttttttttttttttttttttgtttcggttatttaggggtttgaatttagttatttatcgtggcggcggttttggttgcggttttttttcgcgttcgatttatttgggatcggtcgcgatatttcgtttgttagtagggtttagggtcgggaaagttttttttcggtttttcggaggggggaatttttatgacgttttcgtgcgttacgtttcgcgtttttttttattggttgaaagtttaattttggattggcgtagttaattcggagcgattcgggcgcgtttttgagaggggataggtttatttagggcggggagcggggtgataggatattaggcgcgagttcggtcggttaggggatcgtcgagaaggtattcgttgatttagcgttatttcgggtcgggagttttcgttgtttttcggttttggttgcgtttaacgtttggttttttttgaagcgggggatttttagggggaagtcgacggttttagttttcggggtttttattttgagcggcgcgttgtcgggaagttagcggaagaggaaggaagttatttttgcggtcggtttcgggcgttttttggcggtttttttgggttcgcgagtagattttattcggtttcggtttttttttcgtttcgttttattagttttaaggtttcgggagagatagttcggatttcgaatttttttagaagtgataggtttttagcgggttagggtttaggagttttgtttaggagaagggaaatgaagtgtttatttattaaggagatttggaatattagaattgaaaaaggtatttagagtttaaatagtttaaatttttatcgatgtgggaaatcgttttttttttttagttttaggttggaatgtagtgaggggattttggtttattgtaatttttgtttttcgggtttaaattatttttttgttgtagtttatcgagtagttgggattataggcggttattattacgttcgtttaatttatgtatttttagtagagttgggggttttattacgttggttaggttggtttcgaatttttgattttaggtgattcgttggttttcgttttttaaaatgttggaattatagtcgtgagttattgcgtacggtttatttatttatttatttatttatttatgtttttgagatagtgttttgttttgttatttaggttggagtatagtggcgtgattatggtttattgtaatttcgaatttcggggtgcgtcgattttttgatttttttgagtagttggggttataggtgtatattattatatttggtaaattttaaaatttttagtggagatggattttattgcgttgtttaggttggttttaaatttttgggtttaagtgatttttttattttggttttttaaaatgtttggattttggattatagacgtgagttattgtatgttgtcgaattgttttttatagattttttaatttttatttgaatatttttagaggtagcgaggttaggatagaaatttattaagtacggagtatatgattggatttttttttggttagtagcgtttttttttagtaggtgttatgagtaatttttttgtttggagttttttttttttaggtttatggtagaatataaattatttcgggttttttttgtagtttgttttagacgtttttaagaatagaattataggtttgtattggtattaagtaaagagagattattatggttttcgatttgggttgttttttattatttttttatttttttttattttgtttgtaaatatagtgttttagttgttaggttcgggtattttagaagtttttatttttttttttaataattttaggaggtgaatattatttttattgatgaagaaattaaggtttagagaggtggagtaataattaaatatatagttagaaagggatagagttaggatttaaatttaatttgttgattttaggatgaagtttttttttttaagtttatataaaataaagtagttttttttattttattgtgggttttttaaataaatattataagattttgttaaataatttgttgaaatttagatatgttgtttattacgtttttttggtaagttagatttttaattttaaattaaaatggattaaggtcgggtatggtgatttatatttgtaattttagtattttaggaagttaaggttggtggattatttgagtttaggagttcgagattagttttggtaatatggtgaaatttcgttttaaaaaattgaaggggtgggttgtttttttatatttgtgggtgtttttcgtgaggtggaatgagagatttggaaaagaaaaagatatagagataaagtatagagaaaggattcgaggaattagtatttagtatatggaggatttcgttagtttttgagtttttttagtatttattgattatttatgggtgtttttttgagagggggatgtgttatggttataagataatagtggggagagggttagtagataaataaaggtttttgtattatagataaggtaaaggattaagtgttgtgtttttagatatgtatatatataaatattttaatgttttataaagtagtattgttgtttgtatgttttatttttagttttaaggcggtttttttttattttagtagatggaacgtataatcgggttttatatcgagatattttattgtttagggacgggtaggagatagatgttttttttttgttttaattgtaagaggtattttttttttttatattaattttttttagtatagattttttacgggtgtcgggttgggggacggttaggtttttttttttttacgaggttatattttagattattatatggggagaaattttggataatatttggtttttttagatagaggtttttgcggtttttcgtagtgtttgtgtttttgggtatttgagattagggagtggtgatgatttttaacgagtatgttgtttttaagtatttgtttaataaagtatattttgtataatttttaatttatttaattttgagtttgatatagtatatgttttagagagtacggggttgggggtaaggttatagattaatagaattttaaggtagaagaattttttttagtatagaataaaatggagttttttatgtttatttttttttatatagatatagtaataatttgattttttttgtttttttttataaaaatataaaaattagtttgttttataattaggtttttaaataaataaattaaaaattaaaaattaaatgtataatggagtaaatttattttggtatattttagtttagtaaattcgtgttggttattattgattatatttatttttttaaagtgtttataaattgttattaaaattagtacggattttttgagtttttataatatttttaaaagtatttttaagggttgagttattttagttataatagtttaaggcgtaatttatttaaagatgaataaaataagatttttattagagaatattttaaatatataaagatttttattttgggaggttgaggtaggtagattatttgattttaggagtttgagaatagtttgggtaatatagggagattttatgtttatttaagttagttatatgtgatggtgagtgtttgtagttttagttattcggaaggttaaggtgggaggattgtttgagtttaggaagttgaggttgttgtgagttatgttcgtgttattgtattttatttagtttaggtgatagatagacgttgttttaaaaaaagaagagtggagagaatagtataatgagttttcgtgtgtttttttgttagatttaataatttttaatgtatgttagtttggagatttaaattaatttaaaatagtttgttatttgttagagttttatttatttgggtttaagaaatttttttgttaggttgggtata

SEQ ID NO: 215 - DNA, 3529 bp, Artificial Sequence
  chemically treated genomic DNA (Homo sapiens)
  unsure (18)
tttttttttttttttttntgttttttagtagttgttttttatttggttttttagtttttttatatatgttgtatatgaattagaaaatgttttgaagagaaaagtagtgatttgggtttattttagtgagtttttttttattttggatttttggttttgaaaattttggtttttttgagtttttaatgtttttaaaataggttgtttttgtttttgtttgtttgttttttattttattatatttttgtggtttgtttattgggatgtttgtattgttataaagtagtttgttatggttagatgtgggagtttgtgtgtttttttattatgatgtttttttttattataaattttttttatttgtgagttttgtgagaataaggatagtaatttattttatttattttttgtaaaatgttaatttatttattaatttatttaatataggttttgagtatttattatgttgttaagtagttgttaagtgttgaggatagagtagtgaagaagatggataaagttttagttgttatagggcgtatgttttagtatgggatagggtatataaataaataaatagtaagaatattaaatagtaaaaggtgttgtgtataggattaaatttaaatgttgagggagaaggtgggtggttatttaaagttttttttaaatgggtaattattattttgaggtttgaatgataagaaaaagttagttatgaggagatttagggaattttttaggtagagagaggagtaaaggtgagggattagggagtttgttaaagtggattaaatttgtgggattttaaattaaaaattttaatataagtttttttttttaatttttgagattatatatgtataggtaaatattttatttttgtttaaaaatgagaagaattaggatttatataaaattgttgtatttttattagagttttgttattagttaaggttttagtaaaaattaatttaatttatatagtttaagagattgtaaagaagaggttttttaaggggtgtggataggattaagagaacgagtagggttgttgaggtatttagagattagtaatagtggtagttattattattttaggtttgaagggatgaagaatattgtaaagtgttttattttagtttggtgggagttgaagttagggagagatgtagtcgttattagaaaatatgttgtagggtagggtgggagtaggaaggtaatatttttttttttttttttttttgttttattttgaggggtcggttttggttaaatttaattaagagttagttggtagtggagttaggttgatgtggtttagtggaggtagtttttaaggttgtatagagaggggtaagaatgggtttggggagaggtataaattaattatatttttaggtgtatttttgagatgataagtaagaatgaatttggaaagtttataggttttttttgtagttttagttttattaggatttatatgatataaagtgttttttttacgtcgagaatagggggtttgaagggtttttagttatatattatgtttttaaggatagaaattttttttgaggaaatttgtaattagtttgggagattatgaggatataagaatatgtggagttttgaaggaaagttttagggtagagtttggtatttgtgttagtaagaggaagagatttagcgagagattggggataaagttttaagttagagagaggttagagaagaaggtgtttgtagtggaatatgaaatttttagtgtaaatttattaatatttaaaaagagttttttaaatttggttatatattgaaaatttgtttgttaataaagggtttatgatatttaagtaaatatggtatatgatttagaaatagttatttttttaatttagtaatttaaaatagtaaaattttgaaattttattgtttaggatatataaaagtatttatatatatttgtttgtatatttattaatataaaatgttaatgtggatatatattttcgtttgggtttttttttttttttcggttttatttttttcgtcgtcgggggtcggggttttttgtggggggtttagtcggtattttaggtttttttttagtgtcggggtgaattttcgggggagtcgagagtcgggggtagacgggcgggggttggggcggagggagtagcggttttagcgagtttgtggggagaagtaattaagcggggggaggggttgagtagggagggggttttagggtttttttttagttatggattaacggttattggggtcgttttttttaggcggggttcggggggggtttgggattggtgagtggggagtttgggggttttggcgagttttttggtggcggagatttcggtgggggtagcggggggttttcgggaggtcgagggaagtaagatatcggggatattttgtagtagataatgattattatcgattagagtttggacgaggtttaggttaagaaatacgttttaaattgttatcgaatgaagtttgttttttttagcgttttgtgtgaaattaaggagaaaatcggttttagtattcggagtttttaggaggaggagtcggtggatttatagttgatgcgtttggataatatgtttttggtagagggtgtggttgggttcgagaaagggggcggtttagtagtagtagttgtagtcgttgtagtttttggtggtggcgtgttttttgataattttatcgaatattcggattatcgtagtaaatttgtttagattcgttatatatattattcggaattggagaagtatgagtaggtatgtaatgagtttacgatttatgttatgaatttgttgagggagtagagtcgtattaggttcgtggtttttaaagagatggaacgtatggtgagtattatttatcgaaagtttagcgttatttagatgtagttgaagtagagtatttgcgaggttatgatgatgttgcgttttcgttttttggatgttagacgaaagcgtcgtaattttagtagataggttattgaggttttaaatgagtatttttatttttatttgagtaatttatattttagtgaggaggttaaggaggagtttgttaagaagtgtggtattatcgtgttttaggtttttaatcggtttggtaataagaagattcgttataagaaaaatatcggaaagttttaagaggaggtaaatatttatgttgttaagatagtcgtgttagttatttaggggggttatagtagtattagtttttcgatattttttttttttgtaggttttggcggtttttttaatattttaggatttggagatatgtttttggggatgtttgggtttaacggagatttatattttgttttttaggtggtattatttcgacgttcgatggggttagggggttatggggataatttcgggggaggttagatgtatagtttacgggaaatgagggtaaatggtagttggtaagaggttgtgattttttttttagtgatatttttaacggagggattagg

SEQ ID NO: 216 - DNA, 3529 bp, Artificial Sequence
  chemically treated genomic DNA (Homo sapiens)
  unsure (3512)
tttggttttttcgttggggatgttattgaagagggggttatagttttttgttagttgttatttgtttttatttttcgtgggttgtatatttggtttttttcgaggttatttttatagttttttggttttatcgagcgtcggagtgatgttatttgggaagtagaatatgaattttcgttgagtttaggtatttttagaaatatgtttttagattttgagatattgaaagagtcgttagagtttgtagaggaagggggtgtcggggagttggtgttgttgtggtttttttgggtgattgatacggttgttttgatagtatagatgtttgtttttttttggaatttttcgatgttttttttatagcgaatttttttgttgttaaatcggttggagatttgagatacggtgatgttatattttttggtaagtttttttttggtttttttattaggatatgggttatttaggtgggagtagaaatatttatttaggattttagtggtttgtttgttgaagttacggcgttttcgtttggtatttaggaaacgggagcgtagtattattatagtttcgtaggtgttttgttttagttgtatttggatggcgttgaattttcgatggatgatgtttattatgcgttttatttttttgggggttacgggtttggtgcggttttgtttttttagtaggtttatgatatgggtcgtgaatttattatatgtttgtttatatttttttagtttcgagtggtatatgtgacggatttgggtaagtttgttgcgatagttcgagtgttcgatggagttgttaggggatacgttattattagaggttgtagcggttgtagttgttgttgttgagtcgttttttttttcgggtttagttatattttttgttagaagtatgttgtttaagcgtattagttgtgggtttatcggtttttttttttgggagtttcgaatgttgaggtcggttttttttttgattttatataggacgttaaagagagtaggttttattcggtggtagtttagggcgtgttttttggtttgggtttcgtttaggttttggtcggtgatggttattatttgttgtagaatgttttcgatgttttgtttttttcggtttttcgggaatttttcgttatttttatcggggttttcgttattaggaggttcgttagggtttttaggttttttatttattaattttaggtttttttcgggtttcgtttggaggaggcggttttagtagtcgttagtttatagttgggggggggttttgaggttttttttttgtttagttttttttttcgtttggttatttttttttataaattcgttggggtcgttgtttttttcgttttaattttcgttcgtttgttttcggttttcggttttttcgggggtttatttcggtattgaagggagatttgggatatcggttgggttttttataggagatttcggttttcggcggcggagaaaatggagtcggagagagagaggaggtttaagcgggagtgtgtgtttatattgatattttgtgttggtgggtatgtagataagtgtgtatgagtatttttgtatattttgggtaataaaattttaagattttgttattttaaattgttgaattgaaaaaatagttatttttgggttatatattatatttgtttggatattatgaattttttgttagtagatagatttttagtgtatggttagatttaaaggattttttttgggtattggtgaatttatattgaggattttatgttttattgtaggtatttttttttttgatttttttttgatttaaagttttgtttttagtttttcgttgggttttttttttttattagtataaatgttagattttgttttaaaatttttttttaaaattttatatatttttatgtttttatagttttttaagttaattgtaagtttttttaaaaaaaatttttgtttttaaagatataatgtatgattgaaaattttttagattttttattttcgacgtaggaaaggtattttatattatgtaagttttagtaaggttgaagttataaaagaagtttataaattttttaaatttatttttgtttgttattttaaaaatgtatttgagggtgtggttggtttgtgtttttttttaggtttatttttgtttttttttgtgtagttttggagattgtttttattggattatattaatttggttttattgttagttggtttttggttgggtttggttaagatcgattttttaaggtgaggtaggaggaaaaagaagagaagatgttgtttttttgtttttattttgttttgtagtatgttttttggtagcgattatatttttttttgattttagtttttattagattggagtaaagtattttgtaatgttttttatttttttaggtttggggtggtaatgattgttattgttgttagtttttgggtgttttagtaattttgttcgtttttttaattttgtttatattttttaaggagttttttttttgtagttttttgaattatgtgaattggattggtttttgttaagattttaattgataatagagttttgataaaaatataataattttatgtaaattttaattttttttatttttaaataaaaataggatatttgtttatatatatatagttttagaggttaaaaaaagaagtttatgttaaaatttttaatttagaattttataaatttaatttattttagtaaattttttggttttttatttttgtttttttttttgtttgggaaattttttagatttttttatggttgatttttttttgttatttagattttaaagtaatggttatttatttagagaaggttttaagtagttatttatttttttttttagtatttgaatttaattttgtatataatattttttattatttgatatttttgttatttgtttgtttgtgtgttttgttttatgttgggatatgcgttttatgatagttgagattttgtttattttttttattgttttgtttttagtatttggtaattatttggtaatatagtaggtgtttaaaatttatgttgagtgaattaatgaatgagttggtattttataagagataaatgaaataaattattgtttttgtttttatagaatttataaatgaaagaaatttatagtagaagaaagtattataatagaagaatatatagatttttatatttagttatggtaaattattttatggtagtgtaaatattttagtgaataaattataaaggtgtgataaaatggaaaataaataaataaaaataaaaataatttgttttgaagatattggaaatttaaggaagttaggatttttagggttaggagtttagagtgaagagaaatttattgaggtgagtttaaattattatttttttttttagagtattttttgatttatatgtagtatgtgtggaaggattgagaagttaagtagaaagtagttgttaagaagtanaaaaaaaaaaaaaaaaa

SEQ ID NO: 217 - DNA, 1299 bp, Artificial Sequence
  chemically treated genomic DNA (Homo sapiens)
  unsure (1169)
atattaaagttttaaagattttggttttttgttttagttgatttttaagttgtagtatttattaattaatgggttggttcgtttatgttacggggaaaaatatttaaaagaatattattttcgtagaaggtaaaaataaattttttaagtataagtttaaatggggtatgggtaaacgttatttaatcgtagcgatgaaggttattgtttattgagggattacgtagattaattcgaggcgtagttaatttttttagagtaagttcgcggtattcgattttttttttttttttttttggttttttttgacggaagcggaagcggttttcgcgtatattagtcgtttggttttttggtttcggaagttgcgtttttttatttttttcgttggtgttttgttattatggcgttggttgttttgcgggttttggagtttttttcgatcgagatattttcgttggtagtgttgttgttattcgggggttcgtggtcggcggcggagttgggtttggtgttggttttgaggtttgtaggggagagttcggtagggtcggcgttgttggtggtagttttggaggggtcggacgcgggtatcgaagagtagggtttcgggtcgtcgtagttattggttagtcgcgcgttgttgcggtttttggtattgggtttcggggtttgggtgcgggcgcgggcggtgcggcggttttcggcgttaggttgggtattgtttggtatttcgttggggtttgggttcggatcgcgagtcgggtcgttgttggtgaggcgcggagagatttttttagtgttcggatcgcgggtgttggagacgcggtcggcgttgtaagggttgttgggtttagggattcggttggttgtgattgagtttcgcgggcgggttagattgtgtttagagtttggggatagtagtcggtttttattttcgttcgtggtgtttttttttgcggtttttggtatagtgcggcgattttagggagttttgggagggattggagatttattaggggtgagtcggagttgttttcgtggttttggttttttttagggcgaatgggtgtgggtggtttaggttagagagttatcgaatattttatagtcgtatttggttagggtgtaggttttagaatttcgttgggatttttttgatagattgngattcggttttggatcgttgggagagtttttcgttgacggattggcgtttgtttttgttattttggtttttaattttggttgtgattttttggaaatgggagagtttagaatttaggtaggataaaggat

SEQ ID NO: 218 - DNA, 1299 bp, Artificial Sequence
  chemically treated genomic DNA (Homo sapiens)
  unsure (131)
gttttttattttatttgaattttgagtttttttatttttagggggttatagttaagattaaaagttaaagtggtagggataagcgttagttcgttagcgaggggtttttttagcggtttagagtcgggttntagtttattagagaggttttagcgaggttttaggatttgtattttagttaagtgcggttgtgaagtgttcgatgattttttggtttgggttatttatatttattcgttttggaagaggttaaggttacggagatagtttcggtttatttttagtgaatttttagttttttttagaattttttggagtcgtcgtattgtgttagaaatcgtaaaggaggatattacgggcgggggtgggggtcgattgttgtttttagattttggatatagtttggttcgttcgcggagtttagttatagttagtcgagtttttgggtttagtagtttttgtaacgtcggtcgcgtttttagtattcgcggttcgggtattgggagggttttttcgcgttttattagtagcggttcgattcgcggttcgagtttaggttttagcgaggtgttaagtagtgtttaatttagcgtcgggggtcgtcgtatcgttcgcgttcgtatttaggtttcggagtttagtgttaggagtcgtagtagcgcgcggttaattagtagttgcggcggttcgggattttgtttttcggtgttcgcgttcggtttttttagggttgttattagtagcgtcggttttgtcgggtttttttttgtaggttttagggttagtattaggtttagtttcgtcgtcggttacgggttttcgggtggtagtagtattgttaacgggggtgtttcggtcggaaagggttttaggattcgtaagatagttagcgttatggtgataggatattaacgaggagggtgaaggagcgtagttttcggagttagagagttagacgattagtgtgcgcgagggtcgttttcgttttcgttaggggaggttaaagaaaaaggggaggggggtcgggtgtcgcgaatttgttttgagggggttagttgcgtttcggattgatttgcgtggttttttaatagatagtaatttttatcgttgcggttgggtagcgtttatttatgttttatttgaatttgtgtttaaggaatttatttttgttttttacgaaagtaatgtttttttaaatattttttttcgtggtatgaacgaattagtttattaattggtgagtgttatagtttaaagattagttggggtagaaagttagggtttttgaagttttgatgt

SEQ ID NO: 219 - DNA, 3007 bp, Artificial Sequence
  chemically treated genomic DNA (Homo sapiens)
ttttttttttttttgttttttattttttttttttttttatcgtaaatttcgttttttgaggttagatattttataaatttttatatgttggttttcgaattgtgattttttttttaaattttttttttatggttatttttttagacgtttatttttgtttttttttcgtttaggggggcgggggtaggggaaaggaaaataatataattttaggggaagtcgtttttaggtttgttgtttttttattttttttttttaattaaaaaaaaaaaggatatagaaaatattagttttgaatttttttttaagaattcgggttgtaaaggaaattttttttgtttttgttatttatgtgttgttaagttttgaagtggtgagttttaggtcggttttgttaattttatttagtaaaattgtagtgtttttgtttttagatagtattttgtttttttgtttttttaaaaggttatagtgaaagtttggtttggatcgtgtcggttatatggaatggataagggtataattttaaaatgtgattatggggttgtgtgggggcgaaggaggcgatttagttagaaatttattgaaaaggatttcgttttgtaaaaaatcggtttttaaaaaattagaatttcgagattttttttttttttaaaggaaataattgttgttattgagtttattgttttatttagtaattattatatatggttttagtttatgggtagataaatgggatttttagaaagtagtttgttttttgtgtggtaattagatattgtattaaaatgggttgtaacgtgtaatttaaaagaaattttttagtttggtatttgttgagattatagttagtttttgttgttgttatttaagtaggtttgttggaggttgttttttttaattttaaattgaggtttggtgaattttagttcgggtatagagttaaaatgagtaaattgggtgttttatgcgtatttaattttggtttgtaatgtaaagttttttatattacgatttagtgtttaatagatgtttataggtgggtatttaaaggatagtattttatgatttatgtgatattttagattgttaatatattaaattataatgtatcgtttttatttgttgtatagatattagtgttgttaagtttaatgattatttaatatgttttatagtatgtattatgatgttgtgggttatatatttataattttgtttgttattatattgatttagggttaaaaattttttttttttaaatatatgttttaaaaattattttttgttttaggataaggtattaattttagaaaaagttttgtgatatttatatgaaacgttataaagagtgttttgaataagttaataattatttttttttaattttggttttagattgtagtttaatataatggaaaagagtaattttgttaaaaagtggtttaaaaaggtatatttattgttaatgaattttataattaaaaatagatgggatttttattaacggtaaatttttagtttttagtgtgttattttggagtataaagataaatagttattaattttttttaaattttatagttttttaattggtatttttaaggttgtttttaaatttttagattaatattgttgtttttttttttttgattatatggtaagaagtaggttatggttaaatagaagaaaaaatatttatagaaaagttatgttaatataaattggtttttaataaatttagatttaaatagttttagtgtaagaatttataataaaaataagttatattaaattattagatagttaggaaaaatggtaattattttttttggtttttttaaatatgatttttttagttttataagtttaatattttaaatattattaaagtttataaaataattttatttatttgtttttattaattttaattaaaattatattttaaaaatgattttgatattgtttaattattttattataaatgatgggaaaattgatgtttaatatataattgaaaataattatttgttaatttttttgaagttaattataatgttaatgttattgtatgttgaggttatttttgaatattggatattttgttttattagtattattaaggttttttgtttgtgttttttttttttttaattgagtttggtattttaatttaatgtgtatattacgaagtgtatttaattttttaaaaatatttattgttaatagttttttattattaatggatatttaaatattgattttaaaatatatgagttttaatgtattagtacgttggatatttgaaaattttttatttttttttgtttttttaggggtaaattgatttaattatatttttggtttaaaatttgattaggtttgttatataatttttggaattttgatagtagaaaattttttttatgtattaatttataaaagttaatgggagtttaaaaagtagttagatgttagttatttttttttgagatggtttatgttttttttataagaattaatatatatatatatataaaatgtatgtatataatatatatatattagatttttaatattttgaattatgattatttttttattatttattatagtgtttttgttgtattttgtaatgtgtttttaattgttaaaaattgggattacgtaaatgtaatttgttgttttttttatagttatatttgtaataatttttgttttaaaagtaagtttatttttttttatttagtttttttataggttagttatttttttatttatgtgtattggtatagtttttatagattattttgttaatttgaataagaatgtaatgttattatttagaaatatagtaatatttgtattatatttagataggttattttataaatatattatatttgtggagagatatttagagttaaaatatttatataggatatatatatatacgtaggttttcgtttaattataacgtgttttttttttaaattttggtagg

SEQ ID NO: 220 - DNA, 3007 bp, Artificial Sequence
  chemically treated genomic DNA (Homo sapiens)
tttgttagaatttaaaaagaagatacgttatagttgggcggggatttacgtgtatatatgtgttttatgtaaatgttttagttttagatatttttttataaatataatgtatttgtaaaatggtttatttagatatgatatagatgttattatatttttagatgatagtattatatttttatttaaattaataaaatgatttgtggaaattgtattaatatatatgaataaaaagataattggtttataaaaaaattaagtggggaaaaatgggtttatttttagaataagaattattataagtatagttataaagaaaatagtaaattgtatttacgtagttttaatttttaataattagaaatatattataaaatatagtagaaatattataataaatgatggaaagatgattatagtttaaaatattagaaatttaatgtatatgtattatatgtatatattttatatgtgtatgtatattaatttttatgaaaaaaatataaattattttaaaagaaggtaattaatatttaattgttttttaaatttttattggtttttgtaaattaatgtatagaaaaagttttttattattaaagttttaagagttatgtgatagatttagttaagttttgggttaaagatgtgattggattagtttatttttaaagaaataggaagaagtgaagggtttttaaatatttaacgtattgatgtattaaaatttatgtgttttagagttagtatttaggtgtttattagtaatagagggttgttaataataaatatttttaaaaaattgaatatatttcgtgatatgtatattaggttgaagtgttaagtttaattaaaaaaaaaaaaaatataaataaaaaattttgatgatattggtaaaataaaatatttagtatttagaaataattttagtatgtaatggtattaatattgtaattaattttaaaaaaattaatagataattatttttagttatatattagatattaatttttttattatttatagtaaagtgattagataatattaaagttatttttaaagtatagttttaattagaattgataagaataggtaagtagaattattttatgaattttgatggtatttgaagtattgagtttatgaaattaaggggattatatttaggaaaattagagagaataattattattttttttagttgtttagtaatttgatatagtttgtttttgttgtaaatttttatattggagttatttaaatttggatttgttgaaagttagtttgtattagtatggtttttttgtaaatatttttttttttgtttaattatagtttattttttattatataattaagaaaaggggggtagtaatgttaatttggaagtttaaaagtaattttaagaatgttaattgaagaattataaagtttgagaaaaattaatggttatttatttttgtattttagagtggtatattgagaattaaaggtttatcgttgatagaggttttatttgtttttggttatgaggtttattaataataaatgtgtttttttaaattattttttagtaagattatttttttttattatattaaattgtagtttaaagttaaaattagaaagagatgattattaatttatttaaaatattttttataacgttttatgtggatattatagagttttttttgaaattggtgttttattttagagtagaagatgatttttaaaatatatatttggaaaagaaaaatttttagttttgagttaatataatagtaaataaagttatgggtgtgtagtttatagtattatagtgtatgttataaaatatattaggtgattattaggtttaataatattagtgtttgtatagtaaatgaaagcgatatattataatttaatgtattgataatttaaagtattatataggttatgaaatattgttttttgaatatttatttataagtatttattaaatattaagtcgtggtgtaaaaagttttatattataaattaaaattaaatgcgtataaaatatttaatttatttattttaattttatgttcgggttaaagtttattaaattttagtttgggattgaaaagagtaatttttaataggtttgtttggatgatagtagtaggaattaattatggttttaatagatgttaggttgaagagttttttttgagttatacgttataatttattttagtgtaatgtttggttgttatatagaaagtaagttattttttgaaaattttatttatttgtttataaattaagattatatatgataattattgaataaaatagtgaatttagtaataataattattttttttaaaaggaaagaaaatttcgaaattttagttttttaggaatcgattttttgtaaagcgagattttttttaatgagtttttagttggatcgtttttttcgtttttatataattttataattatattttaagattgtgtttttatttattttatatggtcggtacgatttaggttaagtttttattgtgattttttaaagagataaagaagtaaagtattatttagaaatagaaatattgtagttttattgagtgaaattagtaaaatcgatttgaaatttattattttaaaatttgatagtatataaataataaaaataaaggagattttttttgtagttcgggtttttgaagagaagtttaagattgatgttttttatgttttttttttttttaattaaaaaaaaaaaataaaaaagtagtagatttgaaggcgattttttttgaaattgtattattttttttttttttattttcgtttttttaagcgggggaagggtagaaataaacgtttagaagagtagttatgagaaaggggtttaaaaaaaaaattataattcgaaaattaatatataggggtttgtaaaatgtttaattttagagaacggggtttgcgatggggaggaggggagagtgggaagtagggaggaggaaga

SEQ ID NO: 221 - DNA, 14708 bp, Artificial Sequence
  chemically treated genomic DNA (Homo sapiens)
ggttgtatttttttgtttttatttttttgttttttttatttgttttagtttggttatattagtattttgggttttttgttttgtgtttgtttgtttgtttgtttgtttgtttgtttgttttgggatggagttttattttgttatttaggttggagtgtagtgatatgattttggtttattgtaatttttattttttgggtttaaatgatttttttgttttagttttttaagtagttgggattataggtatttattattatatttagttaatttttgtatttttgtagagatgaggttttgttatgttggttaggttggttttaaatttttgattttaggtgatttgtttattttagttttttaaagtgttgggattataggtgtgagttattgagtttagtttgttttgttgttttttgagatggagttttattttgtcgtttaggttggagtgtagtggtataattttgtttgattgtagtttttattttttgagtttaagagatttttttgttttagttatataagtagttgggattataggcgcgtgttattatatgcgtttaattttggtatttttagtagcgatggggttttgttatattggttaggttggtttcgaatttttggttttaagtgatttgtatatttcggttttttgagtagttgggattataggcgtgagttattatgtagggtttttttggttttttaacgtataaagttattttttagttttgggtgtttatagtattattgttagtttttggaaagttttttttagaagtttttatatgattgattttttatttttttttaggttttagtttaaatgttttttttttagagagtttttttttgattattttatgtaatgtgtttttttttagttagtttttttttattttgtgtattttttttagagtatttattattattttggttttgatgtttgttggtttatatgtttgttgtttgttttttatatagaaagtaaattagttttttatttgttttgtttattattttattttagtatagtgattaatatatattagtagttaattaataaatagttataagttaggtacggtgatttatatttgtgattttcgtattttgggaggttaaggtgggcggattttttgaggttaggaatttgatattagtttgtttaatatggcgaaatttcgtttttattaaaattataaaaattagtcgagtgtgatggcgtgcgtttgtaatattagttatttgtgaggttgaggtaggagaatcgtttgaattcgggaggtagaggttgtagtgagtcgagattatattatagtattttagtttgggtgatagagtaagattttgttttaaaaaaataagaaatagaaatatatatatgttgttataagaaatttattattttttagtaaaaaatatagatttttaattaaagaaaggggaaatttttttttaaataattttagaattcggggtagaaaacgttatatgtggaaattcgttttgaaaaatagtttcgtttgtgaataggaaatatttggattatattttttttatttttacgaaggatttaaatgtgtagtattgatgaagaggtagttagttttagtttttattatttttgtatattttatttgtttttttttatggtatagttttgggggtaggttataaattcgtaagatgttattagtattattggttaagatgtaggaatcgttaggagttttagaaataggggagagttagaaagttggttagatttatgttttttaagtgtagggttagggttgagtttgtttttggggtaggtaagtttttttgaatttttgagggaagtagaagatataaattgttagataaaatgtaagtttagtttaaaagggttacgtgtcgttttttttagttttggggtattttttttttagaaaattggattgttttatagtgaaaatttcgggggtggttagttttttgtttcgttgttatttttattatttatagttttttaagaagtttttaggttgggtgttgaattttgattaggaattattgagaaatcgaggtagttgggagaagttgtagttttaagcgttgaaaggaagatgggggataataaatttgggtcgttaagtaaagggggtagaggtttggagaagtgggttttaggattagaggatagatcgattttatattttatttttttagattttatattttattgttattattatttacgtgtttttttcgttttttgtagcgggttttttagaggtattttttatggtttttttagattttaattttggttcgttcgttttttttttagaaaggttttcgtttgttttttttgtaggaaggtttgtatttttagaaagtttttgtttttcgattcgaggatttaatttattaggggaattaaattttgtttttaggggagtggagagagaaattgggtttttttttcgtagtttttgggatatagttgagttagttataggatttggggataatcggggcggattttttttttcgggaggcggtggtattagtttagagttcgtatttttatttatcggggaagcgtggggagaaggatgggttggagttgggttttggtttgaaggatagtagttcggagttaacggttgagtttttaaagtttttatattgtagaggaagtatagcggagattagttttagttaggatggtttcgaagtttttagggattcgacgtagagttaaagaaatttatttgtgtttttttttttttttgggagtaggtagaagattttcgggaggagaggcgaatagcggacgttaatttttttgaaagtattgtgttttttagtatcgcgggtcgttacgggttttttgttgtcgcgggatttcggtttatttttcgattgggtcgtcgtatttcggattagatttcgcgggcgatttacggaattcgcggagtcgggacgtgaaaggttagaaggtttttcgtttttattaagttttagggtttttcgtggttgttgggagttgtagtttgaacgtttttattttggcgagaagcgtttacgttttttttatcgagtttcgcggtaatttttaaagtatttgtatcgttttttcgtcgtttgtagagggcgtagtaggttttgtattttttttgtattttattttttaggttttagatttgttttttttatttaaaaaatatttattatcgagtttttatttgttatttagtattgatataggtatttaggaatataataatgaataagatagtagaaaaattttatatttttataaggtttacgtttttatgtattgaaagtaatgaataaataaattttattagagtgataagggttgtgaaggagattaaataagatggtgtgatataaagtatttgggagaaaacgttagggtgtgatattacggaaagtttttttaaaaaatgatattttaattgatgagaagaaaggatttagttgagagtaaacgtaaaagtttttttttttttattttttatatttgatataatgtaggatttttttaaaatgatttttattaattttgtttttatagttttggtttgtagaattttttattttaaaatgttagtatttacggtattaggtcggcgagaattttgattttgtatttttttttttaattttattttttttgtttttttcggtaggcggattatttgtttttatttgttatggcgattgtttagttttgtgttaggagtttcgtaggggttgatgggattggggttttttttttttatgtgtttaagattggcgttaaaagttttgagttttttaaaagtttagagttatcgtttagggagtaggtagttgttgggtttcggggatattttgcgttcgggttgggagcgtgttttttacgacggtgatacgtttttttggattgggtaagtttttgattgaatttgatgagttttttttgagttacgggttttcggtttcgtgtatttttagttcgggaaaatcgttggggttgggggtggggtagtggggatttagcgagtttgggggtgagtgggatggaagtttggttagagggattattataggagttgtattgttgggagatttgggtgtagatgatggggatgttaggattattcgaatttaaagttgaacgtttaggtagaggagtggagttttggggaattttgagtcggtttaaagcgtatttttttgtatatttattcggtgttgggcgtagggaatttttgaaataaaagatgtataaagtattgaggtttgagatttttggatttcgaaatattgagaatttatagttgtatattttagagtttatggtattttagtgaaaattggggttttatttcgaaatgattatttgggggtgattcggggagtttaagttgttaaggttttataattttcggatttttgttttttttggagcgatttttttaggtagttttcggtttcgttagatggagaaaatttaattgaaggttgttagtcgtggaagtgagaagtgttaaattaggggtttgttcgttaggtcgaggaggatcgtcgtaatttgagaggttcggtagttttgttattgtttggttttatatttatatttttgttttttgtagtagtattttcggtttttttttgtcggagtagtttattatttattcgatgagaggggaggagagagagagaaaatgttttttaggtcggttttttttatttggtagagggaggttgttatttttcgtttgtatttttttttttggattatttagttatggtttttgtaaaggtaggggtatttgttttgatgtaaattttaatttttttttttttttgaatggtgtgttttatttcgcgggtcgtttgtaatttaggcggacgttattatggcgtgagatagggagggaaagaagtgtgtagaaggtaagttcggaggtatttttaagaatgagtatattttattttttcggaggaaaaaaaaaaagaatgggtacgtttgagaattaaattttgaaagagtgtaatgatgggtcgtttgataatttgtcggaaaaataatttatttgttatttagttttgggttaggttattttagttttagacgtaggttgaacgtcgtgaagcggaaggggcgggttcgtaggcgttcgtgtggtttttcgtgtagtttttcggttcgagtcggttttttttggtaggaggcggaattcgaatttatttttttcgttgttttattttttagttcgcggttgttttatttcgtagtttttttttatgtatttgtcgcgtatcggttattttgtgtcgtatttacgttattttttttttaaatcgaggtggtatttatatatagcgttagtgtatatagtaagtgtataggaagatgagttttggtttttaatcgtttcgtgatgtttattaagttatagattttttttatcgttttagaaacgttttattacgtttttttttagtcgattttcgattttatttttattttgatttttataattattttgtttgttggagaattttatatagaatggaattaggttgggcgttgtggtttacgtttgtattttgggaggtcgaggcgggcggattatttgaggataggagttttagattagcgtggttaacgtggtgaattttcgtttttattaaaaaatataaaaattagttgggcgtggtgggtgtttgtaattttagttattcgggagggtgaggtaggagaatcgtttgaattcgggaggtagaggttgtagtgagttaagatcgtgttattatattttagtttgggcgataagaacgaaatttcgttttaaaaaaaaggggggaattatatattatgtgtttatttttgtcgggtttttgttttttaatgtattgtttgatattcgtttatgttgtatatattagtattttgtttttttttatttagtatagtttatcgattgtatattcgtttttttgatggttttttgagttgttttttatttgcggttatgaaataaagttgttataaatatttttgtataattttttttgtgattatatgttttcgtgttttttggagaaatatttaggaggggaattgcgagtttggaagtaaaaagtagttgtattttgaatttttttagaagttttgagttttttagagcggttgtattattttatattttaattagtaaggtatgggagttattatggttgtgttatagtttttcggatattaggtattgttagtttttttaatgtggtatatttttgtggttgtaatttatagttttttattgattaaggatgtttagtatttttttatgtgtttattggttattcgtattttgtttgtaaagtagtttttcgagttttttatttgttattttggttttttgtttgtttttattgtttagttgtgggattgttttatatattttggatataagttttttattagatttatgtgtcgtgaatgtttttttttgatttgttgtttgtttatttgtttgttttatagagtttatagtattttaagaggagtggatttattttttttatgtttagtatttgttttgttttgtttaggatatttttttttttttttttaattttagggttatgaagatattattttatatttttttttaggatttttatggttgtaagttttatagtaaggtttttgagttattaattaatttttaaaattaattgtttatggtgtgaggtgtaggagttagtttttggtattttttttgtatggaaatttagttattttgtttttatttgttgaaataggttttttttttttattgaatgtttttaattttaattattttatagttggagtatagggttattattttagtgttattttttttttttttttgttaatttttgagatagggatttatattgttgtttaggttagagtataatggtataattaaggtttattgtagtttcgaatttttgggtttaagtagttttttagtagttttacgagtagttgggattattttattatatttagttaattattttatttttttgtattgataggattttattatgttgtttaggttggttttaaattgttggttttaagtttttattttatttcggttttttaaagtgttgggattataggtgtgagttattatgtttgattttttagtgttattttttatttattttttttgttttttgttttttttaaacgttggaggaagaaatagtatttattttatataaattttttagaaaatagaggaatagattgggcgcggtggtttatatttgtaattttagtattttggtacgttgaggtaggggattatttgaggtcgggagttcgagattagtttggttaatacggcgaaattttatttttattaaaaatataaaaagtagttaggcgtggtgatatatatttgtaatgttagttatttaggaggttgaggtataagaattttttgaatttgggaagcggaggttgtagtgagtcgagattgcgttattgtattttagtttgggtaatagagtgagattttgttttagaaaaaaaaagaaagaaagaaaaaatagaggaatattttttaatttgttttcgaagttagtataattttggtattaaaattaaataaggatattataagaaaagaaaatatagattaatatttttgttagtatagatatgtaatagttaattaattttagtaaattaaatttggtaatatagaaaaaaggataaataggttagtcgcggtggtttacgtttgtaattttagtattttgggaggttgaggtaggtagattatttgaggttaggagtttgagattagtttgattaatatggtgaaatttcgtttttaataaaaatataaaaattaggttgggtacggtggtttacgtttgtaattttagtattttgggaggtcgaggtgggtagattacgaggttaggagtttaagattagtttgattaatgtggtgaaacgttatttttattaaaaatataaaaattagtcggtgtggtggtatttgtttgtaattttagttatttaggaggttgaggtagaattgtttgaattcgggaggtagaggttgtagtgagttaagatcgtgttattgtattttagtttgggcgatagagtaagattttattttaaaaaaaaaaaaaaattagttgggtatggtggtgggtatttgaaattttagttattcgggagtttgaggtaggagaatcgtttgaatttaggaggtagaagttgtattgagttgggattatattattgtattttagtttgggtaatagagtgagattttattttaaaaaaagaaaaagaaaaaggataaatatattttaattaaataatgtttattttatgattgtagttgatttaatatttaaaaattggtttggtgtagtagtttaggtttgtaattttaatattttaggaggttgaggtaggaagattttttgagtttaggattttaagattagtttgggtaatatagttagattggtttttattggggggaaaaaaattagtttgtgtaatttattatattaataaagggaaatataaaaattttatgattattttaatagatgtagtaaaagtagttaatgatatttaatatatatgtatgattataaattaattaattttttagtaaattagggaaaggaaatttaatttagtttgataatagggcgtttatagtcggagttttattagtagtatatataatggtagaaaatttagtgttgtcgggcgcggtggtttacgtttgtaatgttagtattttgggaggtttaggcgggcggattacgaggttaggagatcgagattgttttgattagtatgttgaaatttcgtttttattaaaaatataaaaataaaaaattagtcgggtatggtggcgggcgtttatagttttagttattcgggaggttgaggcgagagaatggcgtgaattcgggaggcggagtttgtagagtttagatcgtgttattgtattttagtttgggtgatagagtgagatttcgttttaaaaaaaaaaaaaaaaaaaaaagaaaagaaaatttaacgtttttttttttaagattaggaattagaaaaggatttgatttttataacgttgatattatattggaggttttaattaggtaagaaaaagaaataatgagggtcgggtgcggtggtttaggtttgtaattttagtattttgggaagtcgagacgggtggattacgaggttaggagatcgagattattttggttaatacggtgaaattttgtttttattaaatatataaaaaattagtcgggcgtagtggcgggcgtttgtagttttagttattcgggaggttgaggtaggagaatggcgtgaatttagggggcggagtttgtagtgagttgagatcgagttattgtattttagtttgggcgatagagtaagattgtgttttaaaaaaaaaaaaagaaaaagaaataatgattagtggttcgatgttttacgtttataattttagtattttgggaggtcgaggtgggtagattatttgaggtttggagttggagattagtttgataaagatggtgaaatttcgtttttattaaaatattaaaaaaatagttaggcgttggtcgggtatagtggtttatgtttgtaattttagtattttgggaggtcgaggtgggtggattatttgaggttaggagtttaatattagtttggttaatatggtgaaattttatttttattaaaaatataaaaattagtcgggcgtagtggcgggcgtttgtaattttagttatttgggaggtttaggtaggagaatcgtttgaatttgggaggcggaggttgtagtgagtcgagattgtattattgtattttagtttgggtgataaaagtaaaaatttcgttttaaaaaaaaaagaattagttaggggtagtggtgaacgtttgtagttttagttatttaggaggtagaggtaggagaattatttgaatttaggaggtagaggttgtagtgagtcgagattgttttattgtattttagtttaggcgataagagtaaaattttatgttaaaaaaaaaaaaaaaaaaggaaagaaaaaaaataacgattagaaaggaagaaataaaatatatttatagttagtatgattttatatatatatgttttaatggggttaggcgtggtggtttatgtttgtaattttagtatttttaggaggttgaggtaggtggtttttttgggattagtttggttaatatggtgaaattttaattttaataaaaatataaaaaattagttaggcgtggtgacgggtatttttaattttagttatttaggaggttgaggtaggagaattgtttggatttgggaggtagaggttgtagtgagtcgagatcgcgttattgtattttagtttgggtaataagagtgaaatttcggtagggtgtggtggtttacgtttgtaattttagtatttcgggaggttgaggtaggtcgattatttgaggttaggagtttgagattaatttaatatggtgaaatttcgtttttattaaaaatataagaattagttgggtgtagtggtgggcgtttgtaattttagttatttgggaggttgagatagaagaattgtttgaatttaggaggtggaggttgtagtgagttgagattatgttattgtatattacgtcgggtaatagagcgagatttcgttttaaaaaaaaaaaaaaagagtgaaattttattttaaaaaaaaaaaaaagttttaatggaaaatttataaaaagttattaaaattaataaataaatatagtagggttgtaggttatagggtaatatagttatttttttatttgtaggggtttggttttgggattttttatatattaaatttatagatgtttaagttttatatataagacggtatagtatttggatttaatttatatatatttttttatatagtttaaattatttttagattatttatattatttttatataatgaaaatgttaatgtatatgtaagtatgtatgtaagtatttgtattatattgtttagggaattattggatatataggtttttaagattgatattagtagttattgttaagattttggttaggtttgtttttgtttggggttttagttgattttattgtttttttatttagttaagggtatttgtattttttttggttttttggttatttggaaggtttagtttagtttggtatatttgtattttggtttattgatgttggtatttttgggaaggttttgttttgaaaaatacggagattttagttgttattgaagatttgagagataaagatagggagatttgtttgtagatttgtgtttttttaagtgggattgagattttgggttttttattttaggatagtattttttggtttgttgattgaatagatttttgaaggaggtgtatttgtattaatggagtgggggtgggagtagtattatagattcgtattaataattatatagttttttttagaataataatatagaataagtgaaatagaataattgtagaaagagttaatttttgttgagtttttattgtgtgtttagtattttttttaattttatattttttataatatatagagtattaggtaggttaggtttggtggtttacgtttgtaattttagtattttaggaggttaaggggggtggattatttgaggtcgggagtttaagattagtttgattaatatggtgaaatttcgtttttattagaagtataaaattagttaggtgtggtggtatatgtttgtagttttagttatttagtaggttgaggtaggagaattatttgaattcgggaggaggttgtagtaagcggagatagtgttattgtattttagtttgggtaataagagttgagatttcgttttaaaataaaataaaataaaataaaataaaataaaataaaataaaaaaagaaaagagtttgttattaaaggagttgtttggtaggggatgttttgttagtgtaaataatagaaaagtgggttgggtatagtggtttatgtttgtaattttagtattttgggaggttaaggcgggcggattatttgaagttgggagtttaagattagtttgattaatatggagaaatttcgtttttattaaaaatataaaattagtcgggcgtagtggcgtatgtttgtaattttagttattcgggaggttgaggtaggagaatcgtttgaatttgggaggtagaggttgcggtgagtcgagatcgtattattgtattttagtttggacgagagtaaaattttgttttaaaaaaaaaaaaaaatagaaaagtgtaataaatatttatagtaggtatgttttttagtaaatttgatgataaatttggtataaagaaagagagtatttttgaaaaaaaaaaaaagaaaaagaaagagagtattttgtttgggtaatatagtgaaattttgtttttataaaaaaatttaaaaattggtcgggtgtagtggtttatatttgtaattttagtattttgggagtcggaggcgggaggattatttgaggttaggagttcgaaattagtttggttaatatggtaaaattttatttttattaaaaatataaaaaattaattaggcgtattggtgggcgtttgtaattttagttatttaggaagttgaggtaagaggatcgtttgaatttgggaggtggaggttatagtgagtcgagattatattattgtattttagtttgggtgatagggcgagatttcgtttttaaaaaaaaaaagaaaaagaaaaagattaaaaaattagttaggtaggtttttgtggttttagttatttgggaggttgaggtaggagaattattgagtttaggagttcgaggttgtagtgagttatgattgtattattgtattttagtttgggtaataaagtaagattttgttttaaaagaaaaaagaaagaaagaaagaatatggcgggttaggtatagtggtttatatttgtaattttagcgttttgagaggtcgaggtaggtggattataaggttaggagttttatattagtttggttaatatggtgaaattttgtttttattaaaaatataaaaaattagttaggtatggtggtaggggtttgtaattttagttattcgggaggttgaggtaggagaattgtttgaaattagaaggtagaggttgtagtgagtttagattgtattattgtattttagtttgggcgaaaagagttaaattttattttaaaaaataaataaaaaaataaaataaaagaaaatatggtaaagtttttgaaagtttgtttgggagaaggtgcgatgatagttgtataatttcgtgtaagatgttggtttatataggggttgttttttgttttttttcgtttttttaattttttatataataggtttgtgtgttatttatatttattgagtttaagtaggtgtaaggtattgtgatttaatattttggttagtaagataataagatagattattgttttgtttttaggaagtgtatatgttattagaggaaatagataaaataaataaggaaaagtattagataatgtaagtgttatgagaatgtaaatgaggtgatgtgaattaaaataggatgatttaaagtttgtacgggaaggagtttatttttatgtttttggttagttaaggaattattagttgattagtagagaagggtagttagtttagttagagtttttggggaagagggagtggttgttaagagatgagattaaagaagtcgagacgggttattcgtgaggggtttgtaatgtagggttgaggagtgttcgaagagaatgggtaggtgagcggtgagatagttgtttttttagaagttttgtagtgaaaggaattaaagaaatggagtcgtgtattaggtggggaagggtgggggttaagggggtgtttttttttatatagagattgtaggttgagaatgattatatttttgttaataggaggtgggagtagggtacggtagtttatatttgtaattttggtattttaggaggttgaggcgggtcgattatttgaagtaaggagttcgagattagtttggttaatatgtaaagttttgtttttattaaaaatataaaaattagttgggtgtggtggtattcgtttgtaattttagttattcgggagattgaggtaggagaatggtttgaattcggaaggtagaggttgtagtgagttgagattatgttattgtgttttagtttaggtgatagagagagattttattttaaaaaaaaaaaaaaaatataggaagggagttgggaatagggtgtatatttaggaagttttggggatttagtggtgggaaggttggaagtttttttttgattgttttttttttaaagaagtgtatggttggtgaggggtggggtaggagtgtttgggttgtggtgaaatattggaagagagaatgtgaagtagttattttttttttgttttataggaagtcgagttgttttagatattggtatggtgttgggggagggggttttttttttgtaggtttaggtgatttagggttggaagtgttttatgttggatttttatttttttttttgtagt

SEQ ID NO: 222 - DNA, 14708 bp, Artificial Sequence
  chemically treated genomic DNA (Homo sapiens)
gttgtaagaggaaaagtggggatttagtatgagatatttttaattttgggttatttgggtttgtagagaaggaatttttttttttaatattatgttagtgtttgagatagttcggttttttgtggagtaggaaaagaatggttgttttatatttttttttttaatgttttattataatttaagtatttttgttttattttttattagttatgtatttttttgaggaaaagataattagagagggatttttaatttttttattattaaatttttaagattttttaaatgtgtattttatttttaattttttttttgtattttttttttttttttgagatggagtttttttttgttatttaggttggagtatagtggtatgattttagtttattgtaatttttatttttcgggtttaagttatttttttgttttagtttttcgagtagttgggattataggcgagtattattatatttagttaatttttgtatttttagtagagatagggttttgtatgttggttaggttggtttcgaattttttattttaggtgatcggttcgttttagttttttaaagtgttaagattataggtgtgagttatcgtgttttgtttttattttttgttaataaggatatagttatttttagtttgtaatttttgtatggggaaggatatttttttggtttttatttttttttatttgatatacggttttatttttttgattttttttattgtaaagtttttggaagaataattgttttatcgtttatttgtttatttttttcggatattttttagttttgtattataaattttttacgaatggttcgtttcggtttttttaattttattttttaataattatttttttttttttaaaagttttagttagattggttgtttttttttgttaattaattggtggttttttggttagttaggaatatgggggtaggttttttttcgtgtagattttaagttattttattttaatttatattattttatttgtatttttatagtatttatattgtttgatatttttttttgtttattttatttgttttttttaatagtatatatattttttaagggtagggtagtgatttattttgttgttttgttgattaaagtattagattataatgttttgtatttgtttgggtttaataaatgtgaataatatataagtttgttatatgagaggttaagagagcgagaaagagtaaggggtagtttttgtgtggattagtattttgtacgaagttatgtaattattatcgtatttttttttagataagtttttaaaggttttgttatgtttttttttgttttgtttttttgtttgttttttgagatggagtttggtttttttcgtttaggttggagtgtagtggtgtagtttaggtttattgtaatttttgttttttggttttaagtaatttttttgttttagtttttcgagtagttgggattataggtttttgttattatgtttggttgattttttgtatttttagtagagatagggttttattatgttggttaggttggtgtggaatttttgattttgtgatttatttgtttcggttttttaaagcgttgggattataggtgtgagttattgtgtttggttcgttatgttttttttttttttttttttttttttgaggtagggttttgttttgttgtttaagttagggtatagtggtgtaattatggtttattatagtttcggatttttgggtttagtgatttttttgttttagttttttaagtagttgggattatagaggtttgtttggttaattttttagtttttttttttttttttttttttttggagacggagtttcgttttgttatttaggttagagtgtagtggtgtgatttcgatttattgtaatttttattttttagatttaagcgatttttttgttttaattttttgagtagttgggattataggcgtttattaatgcgtttgattaattttttgtatttttagtagagatggggttttgttatgttggttaggttggtttcgaatttttgattttaggtgattttttcgttttcgatttttaaagtgttgggattataggtgtgagttattgtattcggttaatttttgagtttttttgtagaggtagggttttattatgttgtttaggtaggatgtttttttttttttttttttttttttttttagggatgttttttttttttatgttaaatttgttattagatttgttaagaaatatgtttattgtaagtgtttgttatatttttttgtttttttttttttttgagatagagttttgttttcgtttaggttggagtgtaatggtgcgatttcggtttatcgtaatttttgttttttaggtttaagcgatttttttgttttagtttttcgagtagttgggattataggtatgcgttattgcgttcggttaattttgtatttttagtagagacggggtttttttatattggttaggttggttttgaatttttaattttaggtgattcgttcgttttggttttttaaagtgttgggattataggtatgaattattgtgtttagtttatttttttgttgtttgtattgataaaatattttttattaaatagtttttttaatggtaggtttttttttttttttattttattttattttattttattttattttattttattttgagacggagttttagtttttattgtttaggttggagtatagtggtattattttcgtttattgtaattttttttcggatttaaatgatttttttgttttagtttgttgagtagttaggattataagtatgtgttattatatttggttaattttgtatttttagtagagacggggttttattatgttggttaggttggttttgaattttcgattttaggtgatttattttttttggttttttaaagtgttgggattataggcgtgagttattaagtttggtttatttagtattttgtgtattatgggaaatgtagagttgaggaaagtgttgggtatatagtaagagtttaataaaggttagttttttttgtaattgttttattttatttgttttatattattattttagagagaattgtgtgattgttagtgcggatttgtggtattgtttttatttttattttattaatgtaagtatattttttttagggatttatttagttaataggttaggaggtgttgttttgaaatggggggtttaaagttttaattttatttggagggatataggtttatagataggtttttttgtttttattttttaaatttttagtagtaattaaaattttcgtgttttttagagtaggatttttttaggggtattagtattagtgggttaggatataaatgtgttaggttgaattaggttttttaaatggttagggagttaagagaaatgtaggtgtttttggttgggtgggaaggtaatgagattaattgagattttaaataggggtaggtttgattagaattttaatagtggttgttggtattagttttgaaggtttatatgtttagtgattttttaaataatatagtataagtatttatatatatatttgtatgtatattagtatttttattgtatgggggtaatgtaagtaatttagagataatttaaattatatgggaggatatgtgtaggttaaatttaaatattatatcgttttatatatgggatttagatatttgtgggtttggtgtgtgaggagttttagaattaagtttttatagatagagggataattatattgttttgtaatttgtaattttgttatatttatttattagttttggtagttttttatggattttttattaggatttttttttttttttgagatagagttttattttttttttttttttttgagacggaatttcgttttgttgttcggcgtggtgtgtaatggtatgattttagtttattgtaatttttattttttgggtttaagtaatttttttgttttagttttttaagtagttgggattataggcgtttattattatatttagttaatttttgtatttttagtagagacggggttttattatgttaggttggttttaaatttttgattttaggtgatcggtttgttttagtttttcgaagtgttgggattataggcgtaagttattatattttgtcggagttttatttttgttgtttaggttggagtgtaatagcgcgatttcggtttattgtaatttttgttttttaggtttaagtaatttttttgttttagttttttgagtagttgggattagaggtgttcgttattacgtttggttgattttttgtatttttattagagttggggttttattatgttggttaggttggttttagggaagttatttgttttagttttttaaaagtgttaggattataggtatgagttattacgtttggttttattaggatatgtatgtatagaattatattggttgtgaatgtgttttatttttttttttttaatcgttattttttttttttttttttttttttttttttttgatatggaattttgtttttgtcgtttaggttggagtgtaatgggataatttcggtttattgtaatttttgttttttgggtttaagtgatttttttgtttttgttttttgagtagttgggattataggcgtttattattatttttggttaatttttttttttttgagacggagtttttgtttttgttatttaggttggagtgtaatggtgtaatttcggtttattataattttcgttttttaggtttaagcgatttttttgtttaagttttttaagtagttgggattataggcgttcgttattacgttcggttaatttttgtatttttagtagagatggggttttattatgttggttaggttggtgttgaatttttgattttaggtgatttatttatttcggttttttaaagtgttgggattataggtatgagttattgtattcggttaacgtttggttatttttttaatattttaatagagacgaggttttattatttttgttaggttggtttttaattttagattttaggtgatttgtttatttcggttttttaaagtgttgggattataggcgtgagatatcgggttattaattattatttttttttttttttttttttttgagatatagttttgttttgtcgtttaggttggagtgtagtggttcgattttagtttattgtaagtttcgttttttgagtttacgttatttttttgttttagtttttcgagtagttgggattataggcgttcgttattacgttcggttaattttttgtatatttagtagagatagggttttatcgtgttagttaggatggtttcgattttttgatttcgtgatttattcgtttcggttttttaaagtgttgggattataggtttgagttatcgtattcggtttttattattttttttttttgtttggttaaaatttttagtatggtattaacgttgtgagagttaaatttttttttagtttttgattttagaggaaaaagcgttgagttttttttttttttttttttttttttttttttgagacgaagttttattttgttatttaggttggagtgtagtggtacgatttaggttttgtaagtttcgtttttcgggtttacgttattttttcgttttagtttttcgagtagttgggattataggcgttcgttattatgttcggttaattttttgtttttgtatttttagtagagacggggttttagtatgttagttaggatagtttcgattttttgatttcgtgattcgttcgtttaggttttttaaagtgttggtattataggcgtgagttatcgcgttcggtagtattgagttttttattattatgtatgttgttagtggaatttcgattgtggacgttttgttattaaattaggttaagttttttttttttagtttgttaggaggttggttggtttgtaattatgtatatgtgttgaatattattaattgtttttgttatatttgttgaaatgattatagggtttttatgtttttttttgttaatgtggtgaattatatagattgatttttttttttttagtaaagattagtttgattatgttgtttaggttggttttgaaattttgggtttaagagatttttttgttttagttttttaaaatgttgggattataggtttgagttattgtattaggttaatttttgaatgttgaattagttataattatgagataaatattatttggttagaatgtatttattttttttttttttttttttttgagatggagttttattttgttgtttaggttggagtgtaatggtgtgattttagtttagtgtaatttttgttttttgggtttaagcgatttttttgttttagattttcgagtagttgggattttaggtgtttattattatgtttagttaatttttttttttttttgagatgaagttttgttttgtcgtttaggttggagtgtagtggtacgattttggtttattgtaatttttgtttttcgggtttaagtaattttgttttagttttttgagtagttgggattataggtaggtgttattatatcggttgatttttgtatttttagtagagatggcgttttattatattggttaggttggttttgaatttttgatttcgtgatttgtttatttcggttttttaaagtgttgggattataggcgtgagttatcgtgtttagtttgatttttgtatttttattagaaacggggttttattatgttggttaggttggttttaaatttttgattttaagtgatttgtttgttttagttttttaaagtgttgggattataggcgtgagttatcgcgattggtttatttatttttttttttatattattaggtttggtttgttaaaattggttagttgttgtatgtttatgttaataggaatattggtttatattttttttttttataatgtttttgtttggttttggtattaggattatgttggtttcgaaaataagttgggaaatatttttttattttttttttttttttttttttttttgagatagggttttattttgttgtttaggttggagtgtagtggcgtaatttcggtttattgtaattttcgttttttaggtttaagggatttttgtgttttagttttttgagtaattggtattataggtatgtgttattacgtttagttattttttgtatttttagtagagatggggtttcgtcgtgttggttaggttggtttcgaattttcgattttaaatgattttttgttttagcgtattaaagtgttgagattataggtatgagttatcgcgtttagtttgtttttttgttttttgaagagtttgtgtaagatgggtattgtttttttttttaacgtttaaagagagtagagaatagaggagataaatagaaaatagtattaagaggttaggtatggtggtttatatttgtaattttagtattttgggaggtcgagatgggatgaaagtttgaggttagtagtttgagattagtttgggtaatatagtgagattttgttaatataaaaaaataaaatagttagttgggtgtggtggagtaattttagttattcgtgaggttgttagaggattgtttgagtttaggggttcgaggttgtagtaagttttgattgtgttattgtattttagtttgggtaatagtgtgagtttttgttttaaaaattaataaagaaaaaaagaaaatagtattaaaatggtagttttatattttaattgtaaaataattaaaattaaaagtatttagtagagaaaggaagtttattttaataagtggagatagaataattggatttttatataggaaagatattagagattgatttttatattttatattataaataattaattttaagaattaattaatggtttaaggattttattgtaaaatttataattataaaggttttaaaagaaaatgtaagataatatttttatgattttggggttaaaaaaaaaaaaaaagatgttttaaataggataaggtaaatattgaatataaaaaagataaatttattttttttaagatattgtaaattttgtaaagtaaataaataggtaagtaatagattagaagaaaatatttacgatatatggatttgataaaggatttgtatttagaatgtataaagtagttttataattgaataataaaaataaataaaaaattaaaataataggtaaaagattcgaagagttattttataaataaaatacgaatggttaataggtatatgaaaaaatgttgaatatttttagttaatagagaattgtaaattataattataaggatatattatattagaaagattgataatatttaatgttcggaaggttgtggtataattataataatttttatattttgttagttggagtgtaaaatggtataatcgttttggaaaatttagagtttttgaaaaagtttaaaatatagttattttttatttttaaattcgtaattttttttttaagtatttttttaagaaatacgaaaatatatgattataaaaagaattgtataagaatgtttatagtagttttattttataatcgtaaatgggaaataatttaaaaggttattaaaaggacggatatataatcgatggattatattaaatgaaaaggagtaaaatattgatatatataatatgaacgaatgttagatagtatattgaaggatagaagttcgataaaaatgagtatataatgtatgattttttttttttttttgagacggagtttcgtttttgtcgtttaggttggagtgtagtggtacgattttggtttattgtaatttttgtttttcgggtttaagcgatttttttgttttattttttcgaatagttgggattataggtatttattacgtttagttaatttttgtattttttagtagagacggggatttattacgttggttacgttggtttggaatttttatttttaagtaattcgttcgtttcggttttttaaagtgtaggcgtgagttatagcgtttagtttgattttattttatatgaagttttttaataggtaaaatggttatggagattaaaataaaggtggggtcgggaatcgattgggaagagacgtgatgaaacgtttttgggacgatgaaaagggtttgtgatttggtaggtattacggagcggttaggggttaaaatttatttttttgtgtatttgttgtgtgtattggcgttgtgtgtaaatgttatttcgatttaggaaaaagatgacgtaagtacggtataaagtggtcggtacgcggtaggtgtatgggaagaaattgcggaatgaaataatcgcgagttaagagatggggtagcgggagaaatgaattcgagtttcgttttttattaggaagaatcggttcgggtcggagggttgtacggaggattatacggacgtttgcgggttcgtttttttcgttttacgacgtttagtttgcgtttggaattggaatggtttagtttaaagttagataataggtagattgttttttcgataaattattaaacgatttattattgtatttttttaaaatttgatttttagacgtatttattttttttttttttttttcgggaagatgagatatatttatttttgaaaatattttcgggtttgttttttgtatatttttttttttttttgttttacgttatggtagcgttcgtttaggttgtaggcgattcgcggggtggggtatattatttaaagaaggggagggattgaggtttgtattaaaataaatatttttgtttttgtaaaggttataattaagtaatttagaaaaagaaatgtaggcggagaatagtagtttttttttgttaagtaagaggaatcggtttaaaggatatttttttttttttttttttttttttatcgggtgaatagtgagttgtttcggtaaaaagaaatcggaaatgttgttgtaagaggtagaaatgtaaatgtggagttaaataataatagggttgtcgggttttttagattgcgacggtttttttcggtttggcgggtaaatttttggtttagtattttttatttttacgattgatagtttttaattggattttttttatttagcggagtcgggggttgtttggaaagatcgttttaggaaggataaaggttcggaagttgtgggattttagtagtttgggtttttcggattatttttaaatgattatttcggaatggagttttagtttttattaggatgttatgggttttaaaatatatagttatgagtttttaatgtttcgagatttaaaagttttagattttaatgttttgtgtattttttattttagggattttttacgtttagtatcgggtggatgtgtaaagaagtacgttttaggtcggtttaaggttttttaaagttttatttttttgtttaggcgtttaattttgagttcggatggttttaatatttttattatttatatttaggttttttaataatgtaatttttatgatgatttttttagttaagtttttattttatttatttttaaattcgttaagtttttattgttttatttttagttttagcgattttttcgagttgaaaatatacggagtcgagagttcgtgatttagagaggatttattaagtttagttaggagtttatttaatttagggaagcgtgttatcgtcgtggaaagtacgtttttagttcgaacgtaaagtgttttcggagtttagtagttatttgttttttggacggtggttttagatttttgagaagtttaaaatttttagcgttagttttgagtatatgggaggggaaaattttaattttattaatttttgcgaggtttttggtataaagttggatagtcgttatgataagtaagggtaagtaattcgtttgtcggaggaagtaaaggaaatggagttggggaggagggtgtagagttaggattttcgtcgatttggtgtcgtagatattaatattttggggtggaaaattttgtaagttagagttgtgagggtagaattggtggaaattattttggaggaattttgtattgtgttaaatatgaagggtggaaggaagaaagtttttgcgtttgtttttagttggattttttttttttattagttaaaatgttattttttaggaaggtttttcgtaatattatattttaacgtttttttttagatattttatattatattattttatttaattttttttataatttttattattttgataagatttatttgtttattgtttttagtatatggaaacgtaagttttatgaggatatagaatttttttattattttatttattgttgtatttttgagtgtttatattagtgttgggtagtaagtaagagttcgataataaatattttttgaatgagggagataggtttgaagtttggagaatgagatgtagaagaggtgtaagatttgttgcgttttttgtaggcggcgggggggcggtgtaggtgttttaagaattatcgcgggattcggtagggggagcgtaggcgtttttcgttaagatagaagcgtttagattataatttttagtagttacgaggagttttagggtttgatgggaacgggaaattttttaattttttacgtttcggtttcgcgggtttcgtgggtcgttcgcgaaatttgattcgggatgcggcggtttaatcggaaggtggatcgaaatttcgcgatagtaagaggttcgtagcgattcgcggtgttaaggaatatagtgtttttaaaagaattggcgttcgttgttcgttttttttttcgggagttttttgtttatttttagaagaggagggaagtataggtgggtttttttagttttgcgtcggatttttgagaatttcgaagttattttggttgaggttaattttcgttgtgttttttttgtagtatgaagattttggagatttaatcgttagtttcggattgttgttttttagattaggatttagttttagtttatttttttttttacgttttttcgatgaataaaaatgcggattttgaattgatgttatcgtttttcgaaaggggggattcgtttcggttgtttttagattttgtggttggtttagttgtgttttaggagttacgggagggggatttagtttttttttttatttttttggaaatagagtttggtttttttagtgagttgagttttcgaatcgaggagtaagaattttttgaaaatataagtttttttgtagaagaagtaaacgggagtttttttgaagaagaagcgaacgggttagagttggggtttggaaaagttatggaagatatttttggggaattcgttgtagaggacgagggagatacgtaagtggtgatggtagtggagtgtggagtttggggagatgaagtgtgaggtcgatttgttttttggttttgagatttatttttttaggtttttgttttttttgtttggcgatttaggtttattgttttttattttttttttagcgtttggaattatagttttttttagttgtttcgattttttagtggtttttggttagagtttagtatttaatttgagaattttttgaaaggttgtaagtggtaaggataataacggggtagggagttgattattttcgagatttttattgtaaaatagtttagttttttaggagagggatgttttagagttgggagaagcggtacgtagtttttttagattgagtttatattttatttagtagtttgtgttttttattttttttaaggatttaggggggtttatttattttagaggtaggtttagttttagttttatatttgaaaagtataggtttggttagttttttaatttttttttgtttttagggtttttgacggtttttgtattttgattaatagtgttgataatattttgcgaatttataatttgtttttagagttgtattatgagggggagtaggtggaatatgtagaaatggtaaggattggggttaattgtttttttattaatgttgtatatttaagtttttcgtggagatggaaaaagtgtagtttaagtgttttttgtttataaacgggattgttttttaagacgagtttttatatgtagcgttttttgtttcgaattttgaagttatttagagagaggttttttttttttttaattaggaatttgtgttttttgttaaaaagtagtgaattttttgtggtagtatatatatatttttattttttatttttttgagataaggttttgttttgttatttaggttggagtgttgtggtgtgatttcggtttattgtaatttttgtttttcgggtttaagcgatttttttgttttagttttataagtagttggtattataggcgtacgttattatattcgattaatttttatagttttagtagagacggggtttcgttatgttgggtaggttgatattaaatttttgattttagaggattcgtttattttggttttttaaagtgcggggattataggtgtgagttatcgtgtttggtttatagttatttattgattgattattgatatatgttagttattgtgttgggataaagtggtggataagatagatgaagggttggtttgttttttgtgtgggagatagataataaatatgtaaattagtaagtattaggattaagatgatgataaatgttttgaaggaaatatatagaatgaagagagattaattagaggaaagtatattgtataaaatggttaggaaggagttttttgaaaaggaggtatttgagttaagatttgaaggaggataagggattagttatgtgaaggtttttggaaagagttttttaggaattggtaatgatattataaatatttagaattgggaaatagttttgtgcgttaaaagattagaaaggttttgtatggtggtttacgtttgtaattttagttatttaggaggtcgaggtgtgtagattatttgaggttaggagttcgagattagtttggttaatatggtaaaattttatcgttattaaaaatattaaaattagacgtatgtggtggtacgcgtttgtaattttagttatttgtgtggttgaggtaggagaattttttaaatttaggaggtggaggttgtagttagataaaattgtattattgtattttagtttgggcgatagagtgagattttattttaaaaaataataaaatagattgggtttagtggtttatatttgtaattttagtattttgggaggttgaggtgggtagattatttgaggttaagagtttgagattagtttggttaatatggtaaaattttatttttataaaaatataaaaattagttgggtgtgatggtgggtgtttgtaattttagttatttgagaggttgaagtagaagaattatttgaatttaggagatggaggttgtagtgagttaagattatgttattgtattttagtttgggtgatagagtgagattttattttaaaataaataaataaataaataaataaataaataaatataaaataaaaaatttagaatgttggtatagttagattgaggtaagtgagggggatagaggggtgaggatagagaagtgtagtt

SEQ ID NO: 223 - DNA, 6306 bp, Artificial Sequence
  chemically treated genomic DNA (Homo sapiens)
attatttataggatattgggttgtttttatttttaggttagtgtgaatacgttattgtgtgaatatatatttttattttttttgagtttatattttgaaattgaattgtttgtttatatggtaattattttaagaaattgtcggtcgggtgcggtggtttacgtttgtaattttaatattttgggaggtcgaggtaggcggattataaggttaggagatcgagattattttggttaatacggtgaaatttcgtttttattaagaatataaaaaaaaattagtcgggcgtggtggtgggcgtttgtagttttagttattgacgaggttgaggtaggagaatggcgtgaattcgggaggcggagtttgtagtgagtcgagatttcgttattgtattttagtttgggcgatagagcgagatttcgttttaaaaaaaaaaaaaaaaaaaaaagaaattgttaaattgttttttaaagtagttggattattttaggttttttttaaagtagttggattattagtaatataggagggttttattttttttatatttttattaataatatttttatggtattttttattatagtaattttagtgtgtgtgaagtggtattttattatagttttgatttgtatttaagattttttaaataggaaattttttttttatttagttttatttttagatgattagatattaaattaatttattttttaaatagttgttttttttaattataaaaggaatatttgttatttgaaaatgtatggatttataaaatataaaaagtgataaattttttttaattttattttttagagataattaatattaattttttttttttttttttcggttaatatttttagaaagtaattgttaatttttgttattgtatatttttttagttaaaaaaaaaaaaaaaaaagtttaggttgggggcggtggtttatatttgtaattttaatattttgggaggtcgaggcgggtagattacgaggttaagagatcgagattattttggttaatatggtgaaattttcgtttttagtaaaaatataaaaattagttgggtgtggtggcgggcgtcggtagtttttgttatttaggaggttgaggtagaagaattgtttgaatttgggagatggaggttgtagtgagtcgagattacgttattgtattttagtttgggtaatagagtaagattttattttaaaaaaaaaaagtttaatattttatttttaaaacgatttattatatatattgttttataatttgtttttttatttaaagtatttttttttaatggttttgttggtttttattgtataaatatattatgatgtaatttttttttttttttttttggagatggagtttttttttgttattcgagttggagtgtagtggtagaattttggtttattgtaatttttaattttttggtttaagttatttttttgttttagttttttaagtagttgggattataggcgtgtatttttatatttagttaatttttgtatttttagtagaggcggggttttattatgttggttaggatagttttgattttttgattttatgattcgtttatttcggttttttaaagtgttgggattataggcgtgagtttttttttaaaatgagttgagaattgattattataaagtttatgaatagtttattttttaaaataggaagtgttatattgtttttttaaataattgtattaatttgtttttagaatattgaatattatttttgtaattattattttaaattttatttttttaattgtatgtgataatagttatttttttatgttaaaaggtatttatagagatatatattgtgtttatatttttaatttatggtattattttaaatttatttatgttatttattttacggattagattttaaaaataggattttattaaattgttttaaaaaatttttttcgtttttttttttttattaaattgttttaaaaaatttttatcgttttttttttttattaaattgttttaaaaaatttttatcgtttttttttttttttttttcgtttttataagatggagttttgttttgttatttaggttggagtgtagtggtatgattttagtttattgtaatttttgttttttaggtttaaatgatttttttgttttagttttttgagtagttgggattataggtatgtattattacgttcggttaattttgtattttttagtagagacgggttttattatgttaggttgttttcgaatttttgattttagatgatttgtttattttagtttttaaaagtgttgggatgagttattatgttcggtttattgttttatttttttttaaggttttattatttttagttattaaattgacgtgtttattaaatgaagtgatataataaaaaaaaagtgtaattttttttttttttttatttttattttttttttttgagtaattattttatttttattttacgtatttatttagagatagagttttattattttgtcgtttaggttggtgtgtttgttatttaggttggagtgtagtggtgcgattttggtttattgtaacgtttatttttattttttgggtttaagtaatttttgtgttttagtttttttttaagtagatgagattataggtattcgttattacgttcggttaatttttgtatttttagtatagatggggtttttttatgttggttaggttggttttgaatttttaatttttagtgattagtttatttttggttttttaaagtgttgggattataggtatgagttattgcgtttggttattttatgagtaattattttaataatttattgtgtattttttaatataaatatatataaggtgttttgtttgttttaaaaatataattatgtataatatatgtagttttgaaatttttttatgtaatattttatggttatttttttaggtgtatatatagttttaatttatttttttttatagttgggtaatttttagagtatgaatgtattaatttatttttttttttacgtatgaatatgtatgttatttttagtttttgttattataaagaattttataagaaatttgtagatattagatttatagatgagattgtgaaggttaaagggtatatatttgtatttttaattttaatatatattataagatgattttatatattatattattagcgaaaggagtgtttatttttttatttttattgtttgataggtgaaaaatgtggttttttttaaaagtgataattttgattagtagtgtggttaagtatttttttaaatgttaatgattaattagttttttttttttcgggaagagttttttattgtttttgttttttgttagttggtaggggtttattttgttttaggaatgtataattttttgtgtagttaatttttataattattttttagtttattttttgtttgttaatagagttaagaaaaagtttttaaaaaatataattatataggtttatattttattttaagatattttagttatttgttttgttttataatttaaattataatgttttgattaacggaggttttttagtaaattttgatttgaaaaggtagatattttttatttttttagaatgttttggtgttatatagtttttatattcgtttttttgtaatatattttaagttatcgttagttattagttaggtataattaattttaagaagaggtatttatttatatttttatttttgttaattttttggaggttggtattatatcgagaaataaggttatttttgtttataagttgttcgaattttgattagtgcgttattggggaacgaatcgagtgtggatataacgtataaatataaaattttgttcggttttcgtaggaagttgaaattgagaaaggaaatcgagatagtaggagaagggtaattaagatgtttttaaaaataagacggtcggtgcggatagtagtgtagaagttagtaagttggagtgggtaatgtcggtgttttatttttaatttatgggagttattagagcgggggcggagttttatggcggttatattttgttcgttttcgtagtttttttattggagaatcgtagtaaaaggcggaaatcgcggaggcgttttgatttttcggtcggagagatagtttgttttttttaagtttcggggtaggggggtggggagggtaggggggtggggagggtaggggggtggggagggtaggggggtgggggggtggggagggtagggggtgggggggtggggagagtaggggggtggggagagtaggggggtggggagagtagggggtgggggggtggggagagtaggggggtggggagagtagggggtggggagagtaggggggtggggagagtaggggggtggggagagtaggggggtgggggttggggggtggcgtcgtggggggtggcggggtggggggtggggggtggggagagtaggggggtggggggtggggagagtagggcggtgggggagtggcggggtaggggggtggcggggtggggggtggggggagcgcgggcgttgggtgggcggggggtggggcggtgggggggtttgtttcgttttaatcgtcgcgtttgacggtcgtttattggttgtttgtattcgaattatattttttagtaggttttggggttagattggtcgtagttggagaggtgttagttcgtcgtggatgattagagttaattatttgtttttcgttttttaggtagaattatagagaggttatagtcgttttggttttttttcggttttgagagtttttttggtttgttttaagttttaacgttttaagcgtagattgtcggtttcgaacggggagattaggtttttgtatcggaaataaggtatcggttgtgacgttatagtcgtagagcgttcgattttttagaaggtatcgagtttttgtcgttttttttaattggcggcggcgcgaacgaatagtcgtcggcgatttgtgagggtattcggaagggcgaggggagggttcgatcgttcgcgtttagtttttttatttttttcggagtttgagtttttgagtcgtttttagtaaacgtttaggggttgtagaggtttcgagaggtgaggggtttcgtgagggcgggaattaggttgaggtcgtttttggggagcggagcgtgttcgttgttgagggagtaaggtcgggtagggagtttggtgagcgttttaggtaggggcgtacgttgagttttacggtaaaggtgttttttgattagcggaagaggttttagagtgagtttggttcggcggtttttagtgggatgtcgtttgtcgtttttagtagagttttgacggcggagaggagtcggtaggcggtgtgtggatattttttcggttttgtatttgtttttcgggagagttattaatcgttttttcgtttaaagggtatcggagggagtttcggttcgaggggtatagtatggttagatttagtgattaatttgtttttaggtagatgttttcggtattgattttagattttttgttttttagtttattgttttttttttaagtttgatttaatttatttttggtgggttttatatatcgtttttttttttgttttttttttttttttttttttatttttttttttttttttgatttttttttttttttttttttttttttttttttttttttttttagagttagggttttgttttgtcgtttagattgtagtgtagtggcgcgattatagtttattgtagtttcgattttttgggtataagtaatttttttagttttttagtagttgggattataggtttgtgtcgttacgtttagttaattttttttttttttatggagtcggtgttttgttgtgttgtttaggttggttttgaatttttggatttaagcgatttattcgttagggttttttaaagtgttgggattataggtgtgagttatcggtatttggttatattttgtattttttaggaggttggattttggtttttttcgttttatttttatttttttttttttggatttgaggtttgtatagtttttgttttttatttttaggattttttttttatatttttttaagtatattttgtttaaatattgcgttttagttatgatttttttattttagttgtcgttttttttagattttatgtagttttattagttatgttatatattggagtgtagtaatgtcgtgtttggttttttgggtaatttttggtttttttgtttatagt

SEQ ID NO: 224 - DNA, 6306 bp, Artificial Sequence
  chemically treated genomic DNA (Homo sapiens)
gttgtagatagagaaattagggattatttaaaagattaggtacggtattattgtattttaatatgtggtatggttggtgaggttatatgagatttaaagaaaacgatagttgggatagggaaattataattgaaacgtagtatttgaataagatatgtttaggaagatgtgaaaggaagattttgagaatgaaaaatagagattgtgtaaattttaagtttaaagggaagggagtaagggtggagcggagaaggttaaggtttagttttttgagaaatataaagtgtggttaggtatcggtggtttatatttgtaattttagtattttggaaggttttggcgggtggatcgtttgagtttaggagtttaagattagtttgggtaatatagtaagatatcgattttataaaaaaaaaaaaaattagttgggcgtggcgatataagtttgtggttttagttattggggagttgggaggattgtttgtgtttaggaggtcgaggttgtagtgaattgtgatcgcgttattgtattgtagtttgagcgataaagtaagattttgattttaaaaaaagaaaggaaaagagaaaggaaagaaggaggaagggaattagggaagagaaagaaaataaaaggaaaaagaaagaaaagatagaaagaaagacggtgtgtaaaatttattaggaataggttaaattaggtttggagaaagagtaatgggttagaagataggaaatttggggttaatatcgaggatatttgtttaaaagtaggttggttattgaatttggttatattgtatttttcgaatcgaagtttttttcggtgttttttgggcggggaggcggttggtgattttttcggggagtagatgtaaggtcgaggaggtgtttatatatcgtttgtcgattttttttcgtcgttaaagttttgttgagagcggtaggcgatattttattaaggatcgtcgggttaggtttattttggggtttttttcgttggttaaggaatatttttatcgtaaagtttagcgtgcgtttttgtttgaggcgtttattaggttttttattcggttttgtttttttagtaacggatacgtttcgttttttagaggcggttttagtttggttttcgtttttacggagttttttatttttcggggtttttgtagtttttgagcgtttgttggggacggtttagagatttaggtttcgggagagatagaaaaattaggcgcgagcggtcgagtttttttttcgttttttcgagtgtttttataggtcgtcggcgattattcgttcgcgtcgtcgttagttgaggagaacggtagggattcggtgttttttgggaagtcgggcgttttgcggttgtgacgttataatcggtgttttgttttcggtgtagaagtttggttttttcgttcggagtcggtagtttgcgtttgagacgttaagatttgagataggttagaggagtttttagggtcggagggaggttaggacggttgtagtttttttgtggttttgtttggaagacggaaggtaggtggttggttttagttatttacgacgggttggtatttttttagttgcggttagtttaattttagggtttgttgggaaatgtagttcgaatgtaaataattaatggacgatcgttaggcgcggcggttggggcggggtaggtttttttatcgttttatttttcgtttatttagcgttcgcgttttttttattttttatttcgttatttttttatttcgttatttttttatcgttttattttttttattttttatttttttattttttttattttttattttttatttcgttattttttacggcgttattttttaatttttatttttttattttttttatttttttattttttttatttttttattttttttattttttattttttttatttttttattttttttatttttttattttttattttttttatttttttattttttttatttttttattttttttatttttttattttttattttttttatttttttatttttttattttttttatttttttattttttttatttttttattttttttatttttttatttcgaggtttaaaggaagtaagttattttttcgatcggaaaattaagacgttttcgcggttttcgttttttattgcggttttttagtaaaaagattgcggaggcggatagggtgtggtcgttatgggatttcgttttcgttttggtgatttttataggttagagatggggtatcgatattgtttattttagtttgttaatttttatattgttgttcgtatcggtcgttttgtttttaaagatattttaattgttttttttttattgtttcggtttttttttttaattttagttttttacggaggtcgaatagagttttgtgtttgtgcgttgtatttatattcggttcgttttttagtgacgtattgattagggttcggataatttgtgggtagggatggttttatttttcgatgtaatattagtttttagaaagttgataaaagtaaaaatataaatgaatgtttttttttaaagttaattatatttgattaatggttgacgatggtttaaaatatgttataaagaaacgagtatgaaaattgtgtggtattaagatattttagaaaaataaggaatatttgtttttttagattaaaatttattaaaaagttttcgttaattaaagtattatggtttgaattatgaggtaaaatagataattgagatgttttgaagtaaaatataaatttgtgtgattgtattttttaagaatttttttttgattttgttaataaataagaaatagattggaagataattgtaaagattagttatataaaagattatatatttttaagataaaatgaatttttgttaattgataaaaagtaaaggtaatgaggagtttttttcgagaggaggaaaattaattggttattaatatttaaaaagatgtttaattatattattagttaagattattatttttaaagggaattatattttttatttattaaataatgaaggtggagaaataggtatttttttcgttggtagtgtggtgtgtgaagttattttgtaatatatattaaaattaaaagtataagtatgtattttttgatttttataattttatttgtgaatttgatgtttataaattttttgtagaattttttgtagtgataaaaattagaaatgatatgtatgtttatacgtaaggaaaggagtaaattggtgtatttatattttggaaattatttagttatgaaaaagaatggattggaattatatgtatatttggagggatggttataaaatattatatgaaaaagttttagagttatatatattatgtataattatatttttggaataaataaaatattttgtgtatgtttgtgttgagggatatataatagattattaaaatggttatttatgggatggttaggcgtagtggtttatgtttgtaattttagtattttgggaagttagaggtgggttgattattggaggttaggagtttaagattagtttggttaatatggggaaattttatttgtattaaaaatataaaaattagtcgggcgtggtggcgggtgtttgtaattttatttatttgggaggaggttgaagtataagaattgtttgaatttaggaggtggaggtggacgttatagtgagttaagatcgtattattgtattttagtttgagtgataggtatattagtttgggcgatagagtagtaagattttgtttttaaataaatacgtaaaataaaaataaaatggttatttagagggagggaatggaaatggagaaaagggagagattatattttttttttattgtgttattttatttaatgagtacgttaatttggtaattaaaaataataaaattttaaaaaaaaatagaataataggtcgggtatggtggtttattttagtatttttggaggttgaggtgggtagattatttgaggttaggagttcgagagtagtttaatatagtgaaattcgtttttattaaaaaatataaaattagtcgggcgtggtgatgtatgtttataattttagttatttaggaggttgagataggagaattatttgaatttgggaggtagaggttgtagtgagttgagattatgttattgtattttagtttgggtgatagagtaagattttattttgtgggggcggaaaaaaaagaaaaaagaacgataaagattttttaaaataatttgatggaaaaaaagaacgataaagattttttaaaataatttgatggaaaaaaaagaacgaaaaagattttttaaaataatttgatggaattttgtttttagaatttaattcgtaaaataaatgatataaatggatttgaaatgatattataaattaagggtgtaaatataatatgtatttttataaatgttttttaatatgaaaagatggttattgttatatataattaaagaaatgaaatttaaaataataattataaaaataatatttagtattttaaaagtaaattaatataattatttaagagggtaatatgatattttttattttaagaagtaaattgtttataaattttgtaatggttaatttttaatttattttaaagaaaaatttacgtttgtaattttagtattttgggaggtcgaggtgggcggattatgaggttagaagattaagattattttggttaatatggtgaaatttcgtttttattaaaaatataaaaattagttgggtgtagaggtatacgtttgtaattttagttatttgggaggttgaggtaggagaatagtttgaattagggagttggaggttgtagtgagttaagattttgttattgtattttagttcgggtgatagaaggagattttatttttaaaaaaaaaaaaaaaaaggttatattatgatatgtttatatagtggaagttaatagaattattgaaaagagatattttaagtgaaaaggtaagttataaagtagtatgtataataagtcgttttaaaaataaaatgttaggttttttttttttgagatggagttttgttttgttgtttaggttggagtgtagtggcgtggtttcggtttattgtaatttttattttttaggtttaagtaatttttttgttttagttttttgagtagtagggattatcggcgttcgttattatatttagttaatttttgtatttttattagagacgggggttttattatgttggttaggatggtttcgattttttgatttcgtgatttgttcgtttcggttttttaaagtgttgggattataggtgtgagttatcgtttttagtttaggtttttttttttttttttttaattggaggaatatataataataagagttaatagttgttttttagaaatgttggtcgggggggagggaaagagagttaatattggttgtttttaaggagtaggattagaaggaatttgttattttttatgttttataaatttatatatttttaaataataagtgttttttttgtagttgaaaaaaataattatttgaaaggtgagttaatttagtatttgattatttaggagtaaaattaagtgaagaaagaattttttatttaaaagattttgaatgtaaattaaaattataatgagatattattttatatatattagaattattataataaaaaatattataaaaatgttattggtgaggatgtggagaaaatgaaatttttttatattgttggtggtttagttattttggaaaggatttaaaatggtttagttattttggaaaatagtttggtagttttttttttttttttttttttttttgagacggagtttcgttttgtcgtttaggttggagtgtagtggcgggatttcggtttattgtaagtttcgtttttcgggtttacgttatttttttgttttagtttcgttagtagttggaattataggcgtttattattacgttcggttaatttttttttgtatttttagtagaaacggggttttatcgtgttagttaggatggtttcgattttttgattttgtgattcgtttgtttcggttttttaaagtgttgggattataggcgtgagttatcgtattcggtcggtagttttttaaaatagttattatgtgaataagtagtttaattttaaggtataaatttaagagaaatggaaatgtgtgtttatataataacgtgtttatattagtttaaaagtggaaataatttaatgttttgtaagtgat

SEQ ID NO: 225 - DNA, 20 bp, Artificial Sequence
  p53 primer
gtgataagggttgtgaagga

SEQ ID NO: 226 - DNA, 20 bp, Artificial Sequence
  p53 primer
caaaaacttacccaatccaa

SEQ ID NO: 227 - DNA, 18 bp, Artificial Sequence
  p53 detection oligo
aacccctacgaaactcct

SEQ ID NO: 228 - DNA, 18 bp, Artificial Sequence
  p53 detection oligo
aacccctacaaaactcct

What is claimed is:

1. A method for diagnosis and/or prognosis of, or predisposition to a condition or disease comprising:
    converting, in a genomic DNA sample and by chemical treatment, cytosine bases that are unmethylated at the 5-position to uracil or another base dissimilar to cytosine in terms of hybridization behavior to provide chemically pretreated genomic DNA;
    amplifying fragments of the chemically pretreated genomic DNA having a sequence selected from the group consisting of SEQ ID NOS:49, 50 and complements, and portions thereof, using at least one set of primer oligonucleotides and a polymerase to produce amplificates;
    hybridising the amplificates to at least one set of detection oligomers;
    detecting the hybridised amplificates; and
    determining, based on the detection, the methylation status of at least one CpG dinucleotide of the CBFB genomic sequence corresponding to treated SEQ ID NOS:49, 50 and complements thereof, wherein a diagnosis and/or prognosis of, or predisposition to a condition or disease associated with CBFB is afforded, and wherein the condition or disease is a CBFB-associated cancer.

2. The method of claim 1, wherein amplifying the fragments of chemically pretreated genomic DNA using a set of primer oligonucleotides and a polymerase is performed such that the amplificates carry a detectable label.

3. The method of claim 1, wherein hybridising the amplificates to the at least one set of detection oligomers comprises hybridizing wherein the base sequence of the oligomers includes at least one CpG dinucleotide.

4. The method of claim 3, wherein the detection oligomers are oligonucleotides.

5. The method of claim 3, wherein the detection oligomers are PNA probes.

6. The method of claim 3, wherein the detection oligomers are in an array.

7. The method of claim 3, wherein the cytosine of the CpG dinucleotide is located approximately in a middle third of each detection oligomer.

8. The method of claim 3, wherein the set of oligomers comprises at least two different detection oligomers.

9. The method of claim 3, wherein the at least one set of detection oligomers comprises oligomers for detecting the methylation state of at least one CpG dinucleotide of a sequence selected from the group consisting of SEQ ID NOS:49, 50 and complements, and portions thereof.

10. The method of claim 1, wherein the chemical treatment is carried out using a bisulfite reagent.

11. The method of claim 1, wherein the amplified fragments comprise more than ten different fragments having a length of from 100 to 2,000 base pairs.

12. The method of claim 1, wherein amplifying the fragments of the chemically pretreated genomic DNA comprises amplifying more than one DNA segment in one reaction vessel.

13. The method of claim 1, wherein the at least one set of primer oligonucleotides comprises oligonucleotides having at least one contiguous base sequence of at least 9 nucleotides in length that hybridizes to or is identical with a chemically pretreated genomic DNA sequence selected from the group consisting of SEQ ID NOS:49, 50 and complements, and portions thereof.

14. The method of claim 1, wherein the polymerase is a heat-resistant DNA polymerase.

15. The method of claim 1, wherein amplifying the fragments of the chemically pretreated genomic DNA comprises use of a polymerase chain reaction (PCR).

16. The method of claim 2, wherein the detectable label is selected from the group consisting of fluorescent labels, radionuclides and detachable molecule fragments having a predetermined mass detectable in a mass spectrometer.

17. The method of claim 1, further comprising detecting amplificates or fragments of the amplificates in a mass spectrometer.

18. The method of claim 17, wherein the produced fragments comprise a single positive or negative net charge.

19. The method of claim 17, wherein the mass spectrometer uses matrix assisted laser desorption/ionization mass spectrometry (MALDI) or an electron spray mass spectrometry (ESI).

20. The method of claim 1, wherein the genomic DNA is obtained from cells or cellular components which contain DNA.

21. The method of claim 1, wherein the genomic DNA is obtained from a source selected from the group consisting of cell lines, biopsies, blood, sputum, stool, urine, cerebral-spinal fluid, tissue embedded in paraffin, intestine, kidney, brain, heart, prostate, lung, breast, liver, histologic object slides and combinations thereof.

22. The method of claim 1, further comprising treating the condition or disease associated with CBFB, based on the diagnosis and/or prognosis of, or predisposition to the condition or disease associated with CBFB.

* * * * *